United States Patent 11,805,774 (SEED TREATMENT METHODS AND COMPOSITIONS FOR IMPROVING PLANT TRAITS AND YIELD) - sequence listing, part 4

SEQ ID NO: 5737 - DNA, 1525 bp, Microbacterium sp. BR1
  ref <308>: DATABASE ACCESSION NUMBER: NCBI ACCESSION: NZ_NMUN01000004.1
  ref <309>: DATABASE ENTRY DATE: 2019-04-01
  ref <313>: RELEVANT RESIDUES IN SEQ ID NO: (1)..(1525)
ttcacggagagtttgatcctggctcaggatgaacgctggcggcgtgcttaacacatgcaagtcgaacggtgaaagagagcttgctctctggatcagtggcgaacgggtgagtaacacgtgagcaatctgcccctgactctgggataacagttggaaacagctgctaataccggatacgagcttcgaaggcatcttcagaagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagatcggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5738 - DNA, 1526 bp, Microbacterium sp. CGR2
  ref <308>: DATABASE ACCESSION NUMBER: NCBI ACCESSION: NZ_RBHX01000003.1
  ref <309>: DATABASE ENTRY DATE: 2019-04-01
  ref <313>: RELEVANT RESIDUES IN SEQ ID NO: (1)..(1526)
tttacggagagtttgatcctggctcaggatgaacgctggcggcgtgcttaacacatgcaagtcgaacggtgaagcccagcttgctgggtggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5739 - DNA, 1525 bp, Microbacterium sp. CJ77
  ref <308>: DATABASE ACCESSION NUMBER: NCBI ACCESSION: NZ_PQBR01000006.1
  ref <309>: DATABASE ENTRY DATE: 2019-04-01
  ref <313>: RELEVANT RESIDUES IN SEQ ID NO: (1)..(1525)
ttcacggagagtttgatcctggctcaggatgaacgctggcggcgtgcttaacacatgcaagtcgaacggtgaaagagagcttgctctctggatcagtggcgaacgggtgagtaacacgtgagcaatctgcccctgactctgggataacagttggaaacagctgctaataccggatacgagcttcgaaggcatcttcagaagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5740 - DNA, 1532 bp, Microbacterium sp. CPCC 204701
  ref <308>: DATABASE ACCESSION NUMBER: NCBI ACCESSION: NZ_RRYE01000220.1
  ref <309>: DATABASE ENTRY DATE: 2019-04-01
  ref <313>: RELEVANT RESIDUES IN SEQ ID NO: (1)..(1532)
tttatggagagtttgatcctggctcaggatgaacgctggcggcgtgcttaacacatgcaagtcgaacggtgaagcccagcttgctgggtggatcagtggcgaacgggtgagtaacacgtgagcaacctgcccctgactctgggataagcgctggaaacggcgtctaatactggatatgtatcacggccgcatggtctgtggttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagccttcgggtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccggaacgccctagaaatagggaactctttggacactggtgtacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5741 - DNA, 1532 bp, Microbacterium sp. DFW100M-13
  ref <308>: DATABASE ACCESSION NUMBER: NCBI ACCESSION: NZ_CP035494.1
  ref <309>: DATABASE ENTRY DATE: 2019-04-01
  ref <313>: RELEVANT RESIDUES IN SEQ ID NO: (1)..(1532)
tttacggagagtttgatcctggctcaggatgaacgctggcggcgtgcttaacacatgcaagtcgaacgatgaacctggtgcttgcactgggggattagtggcgaacgggtgagtaacacgtgagcaacctgccctggactctgggataagcgctggaaacggtgtctaatactggatatgagatgtgaccgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttggtagggaagaagcctttgggtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaatcccggggctcaacttcgggcgtgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacggtgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatgcaccggtaacggccagagatggtcgcccctttatggtcggtgcacaggtggtgcatggttgtcgtcagctcgtgtcgtgagatgttgggttaagtcccgcaacgagcgcaaccctcgttctctgttgccagcacgttatggtgggaactcaggggatactgccggggtcaactcggaggaaggtggggatgacgtcaaatcatcatgccccttatgtcttgggcttcacgcatgctacaatggccggtacaaagggctgcgataccgtgaggtggagcgaatcccaaaaagccggtcccagttcggatcgtagtctgcaactcgactacgtgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5742 - DNA, 1525 bp, Microbacterium sp. Gd 4-13; identical to SEQ ID NO: 5733
  ref <308>: DATABASE ACCESSION NUMBER: NCBI ACCESSION: NZ_QEIJ01000018.1
  ref <309>: DATABASE ENTRY DATE: 2019-04-01
  ref <313>: RELEVANT RESIDUES IN SEQ ID NO: (1)..(1525)

SEQ ID NO: 5743 - DNA, 1528 bp, Microbacterium sp. HSID17254
  ref <308>: DATABASE ACCESSION NUMBER: NCBI ACCESSION: NZ_RBLT01000072.1
  ref <309>: DATABASE ENTRY DATE: 2019-04-01
  ref <313>: RELEVANT RESIDUES IN SEQ ID NO: (1)..(1528)
tttacggagagtttgatcctggctcaggatgaacgctggcggcgtgcttaacacatgcaagtcgaacggtgaagcaggagcttgctcttgtggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5744 - DNA, 1530 bp, Microbacterium sp. LAM7116
  ref <308>: DATABASE ACCESSION NUMBER: NCBI ACCESSION: NZ_RJAD01000005.1
  ref <309>: DATABASE ENTRY DATE: 2019-04-01
  ref <313>: RELEVANT RESIDUES IN SEQ ID NO: (1)..(1530)
tttatggagagtttgatcctggctcaggatgaacgctggcggcgtgcttaacacatgcaagtcgaacggtgaagcagagcttgctctgtggatcagtggcgaacgggtgagtaacacgtgagcaacctgccccggactctgggataagcgctggaaacggcgtctaatactggatacgagctgcaaccgcatggttagcagttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgctgcagaaatgtagaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5745 - DNA, 1528 bp, Microbacterium sp. NEAU-LLE
  ref <308>: DATABASE ACCESSION NUMBER: NCBI ACCESSION: NZ_QUAB01000025.1
  ref <309>: DATABASE ENTRY DATE: 2019-04-01
  ref <313>: RELEVANT RESIDUES IN SEQ ID NO: (1)..(1528)
tttacggagagtttgatcctggctcaggatgaacgctggcggcgtgcttaacacatgcaagtcgaacgatgaaccgggtgcttgcacctggggattagtggcgaacgggtgagtaacacgtgagcaacctgcccctgactctgggataagcgctggaaacggtgtctaatactggatatgtgccacggccgcatggtctgtggttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgccgtgaaatcctcaggctcaacctgaggcttgcggtgggtacgggcagacttgagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaatgggctgcgataccgtgaggtggagcgaatcccaaaaagccggtcccagttcggatcgtagtctgcaactcgactacgtgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5746 - DNA, 1525 bp, Microbacterium sp. PM5
  ref <308>: DATABASE ACCESSION NUMBER: NCBI ACCESSION: NZ_CP022162.1
  ref <309>: DATABASE ENTRY DATE: 2019-04-01
  ref <313>: RELEVANT RESIDUES IN SEQ ID NO: (1)..(1525)
ggagagtttgatcctggctcaggatgaacgctggcggcgtgcttaacacatgcaagtcgaacggtgaagctcagcttgctgggtggatcagtggcgaacgggtgagtaacacgtgagcaatctgcccctgactctgggataagcgctggaaacggcgtctaatactggatacgaaccgtggaggcatcttcaacggttggaaagattttttggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacttcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5747 - DNA, 669 bp, Microbacterium sp. TPD7012
  ref <308>: DATABASE ACCESSION NUMBER: NCBI ACCESSION: NZ_QDFV01000004.1
  ref <309>: DATABASE ENTRY DATE: 2019-04-01
  ref <313>: RELEVANT RESIDUES IN SEQ ID NO: (1)..(669)
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcgg

SEQ ID NO: 5748 - DNA, 1527 bp, Microbacterium sp. Y-01
  ref <308>: DATABASE ACCESSION NUMBER: NCBI ACCESSION: NZ_CP024170.1
  ref <309>: DATABASE ENTRY DATE: 2019-04-01
  ref <313>: RELEVANT RESIDUES IN SEQ ID NO: (1)..(1527)
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5749 - DNA, 1531 bp, Microbacterium sp. YZGP509
  ref <308>: DATABASE ACCESSION NUMBER: NCBI ACCESSION: NZ_PNEY01000014.1
  ref <309>: DATABASE ENTRY DATE: 2019-04-01
  ref <313>: RELEVANT RESIDUES IN SEQ ID NO: (1)..(1531)
tggagagtttgatcctggctcaggatgaacgctggcggcgtgcttaacacatgcaagtcgaacgatgaagcaccagcttgctggtgtggattagtggcgaacgggtgagtaacacgtgagcaacctgccccggactttgggataagcgctggaaacggcgtctaataccgaatatgcaccatgaaggcatcttcaatggtgggaaagatttatcggtccgggaggggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaaccccttttagtagggaagaagccttcgggtgacggtacctgcagaaaaagcgccggctaactacgtgccagcagccgcggtaatacgtagggcgcaagcgttatccggaattattgggcgtaaagagctcgtaggcggcttgtcgcgtctgctgtgaaaactggaggctcaacttccagcgtgcagtgggtacgggcaggctagagtgcggtaggggagattggaattcctggtgtagcggtggaatgcgcagatatcaggaggaacaccgatggcgaaggcagatctctgggccgtaactgacgctgaggagcgaaagagtggggagcgaacaggcttagataccctggtagtccactccgtaaacgttgggaactagttgtgggggcctttccacggtctccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccggaaacggcgagagatcgtcgcccccttgtggtcggtgtacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcggcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaaccccttgtgggagggagctgtcgaaggtgggatcggtaattaggactaagtcgtaacaaggtagccgtaccggaaggtgcggctggatcacctcctttctaagga

SEQ ID NO: 5750 - DNA, 1531 bp, Microbacterium sp. YZYP306; identical to SEQ ID NO: 5749
  ref <308>: DATABASE ACCESSION NUMBER: NCBI ACCESSION: NZ_PNFD01000009.1
  ref <309>: DATABASE ENTRY DATE: 2019-04-01
  ref <313>: RELEVANT RESIDUES IN SEQ ID NO: (1)..(1531)

SEQ ID NO: 5751 - DNA, 1530 bp, Microbacterium sp. cf046
  ref <308>: DATABASE ACCESSION NUMBER: NCBI ACCESSION: NZ_FOZJ01000002.1
  ref <309>: DATABASE ENTRY DATE: 2019-04-01
  ref <313>: RELEVANT RESIDUES IN SEQ ID NO: (1)..(1530)
ttttacggagagtttgatcctggctcaggatgaacgctggcggcgtgcttaacacatgcaagtcgaacggtgaaagagagcttgctctctggatcagtggcgaacgggtgagtaacacgtgagcaatctgcccctgactctgggataagcgttggaaacgacgtctaataccggatacgagctgcgaaggcatcttcagcagctggaaagaacttcggtcagggatgagctcgcggcctatcagctagttggtgaggtaaaggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaactgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5752 - DNA, 1529 bp, Microbacterium telephonicum
  ref <308>: DATABASE ACCESSION NUMBER: NCBI ACCESSION: NZ_RCDB01000006.1
  ref <309>: DATABASE ENTRY DATE: 2019-04-01
  ref <313>: RELEVANT RESIDUES IN SEQ ID NO: (1)..(1529)
tttacggagagtttgatcctggctcaggatgaacgctggcggcgtgcttaacacatgcaagtcgaacgatgaagcccagcttgctgggtggattagtggcgaacgggtgagtaacacgtgagcaatctgcccctcactctgggataagcgctggaaacggcgtctaatactggatacgagctgcgaccgcatggtcagtagttggaaagaatttcggtgggggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatctggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgccgcagaaatgtggaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5753 - DNA, 1525 bp, Microbacterium trichothecenolyticum
  ref <308>: DATABASE ACCESSION NUMBER: NCBI ACCESSION: NZ_QTTZ01000001.1
  ref <309>: DATABASE ENTRY DATE: 2019-04-01
  ref <313>: RELEVANT RESIDUES IN SEQ ID NO: (1)..(1525)
tttatggagagtttgatcctggctcaggatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagctctcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcaaggaagaagcttttgtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacatcccagaaatgggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5754 - DNA, 771 bp, Microbispora triticiradicis
  ref <308>: DATABASE ACCESSION NUMBER: NCBI ACCESSION: NZ_QFZU02000207.1
  ref <309>: DATABASE ENTRY DATE: 2019-04-01
  ref <313>: RELEVANT RESIDUES IN SEQ ID NO: (1)..(771)
tttttcggttggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcagcagggacgaagttgacgtgtacctgtagaagaagcgccggctaactacgtgccagcagccgcggtaatacgtagggcgcgagcgttgtccggaattattgggcgtaaagagctcgtaggtggcttgtcgcgtctgccgtgaaagcccgtggcttaactacgggtctgcggtggatacgggcaggctagaggctggtaggggcaagcggaattcctggtgtagcggtgaaatgcgcagatatcaggaggaacaccggtggcgaaggcggcttgctgggccagttctgacgctgaggagcgaaagcgtggggagcgaacaggattagataccctggtagtccacgctgtaaacgttgggcgctaggtgtgggggtcttccacgatctctgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatacaccggaaa

SEQ ID NO: 5755 - DNA, 1556 bp, Micrococcus lylae
  ref <308>: DATABASE ACCESSION NUMBER: NCBI ACCESSION: NZ_UGPR01000001.1
  ref <309>: DATABASE ENTRY DATE: 2019-04-01
  ref <313>: RELEVANT RESIDUES IN SEQ ID NO: (1)..(1556)
attatggagagtttgatcctggctcaggatgaacgctggcggcgtgcctaatacatgcaagtcgagcgaacggacgagagtgcttgcactctctgaagttagcggcggacgggtgagtaacacgtgggtaacctacctataagactgggataacttcgggaaaccggagctaataccggataatatttagcttcgcatgaagcaatagtgaaagacggttctgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaggttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttct

SEQ ID NO: 5756 - DNA, 1531 bp, Micrococcus sp. FDAARGOS 333
  ref <308>: DATABASE ACCESSION NUMBER: NCBI ACCESSION: NZ_NJFJ02000001.1
  ref <309>: DATABASE ENTRY DATE: 2019-04-01
  ref <313>: RELEVANT RESIDUES IN SEQ ID NO: (1)..(1531)
tttacggagagtttgatcctggctcaggatgaacgctggcggcgtgcttaacacatgcaagtcgaacgatgaagctccagcttgctggggtggattagtggcgaacgggtgagtaacacgtgagtaacctgcccttgactctgggataagccttggaaacggggtctaataccggataggagcattcaccgcatggtgggtgttggaaagaatttcggtcttggatggactcgcggcccatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgttcgccgtagagatacggtttcccctttggggcgggttcacaggtggtgcatggttgtcgtcagctcgtgtcgtgagatgttgggttaagtcccgcaacgagcgcaacccctgttctatgttgccagcacgtgatggtggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagttggagtcgctagtaatcgcagatcagcaacgctgcggtgaatacgttcccgggccttgtacacaccgcccgtcaagtcacgaaagtcggtaacacccgaagccggtggcctaacccttgtggaaggagccgtcgaaggtgggactggcgattgggactaagtcgtaacaaggtagccgtaccggaaggtgcggctggatcacctcctttctaagga

SEQ ID NO: 5757 - DNA, 1530 bp, Micrococcus sp. HSID17227
  ref <308>: DATABASE ACCESSION NUMBER: NCBI ACCESSION: NZ_RBLN01000133.1
  ref <309>: DATABASE ENTRY DATE: 2019-04-01
  ref <313>: RELEVANT RESIDUES IN SEQ ID NO: (1)..(1530)
tttacggagagtttgatcctggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactaggtctaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccagcgattgggactaagtcgtaacaaggtagccgtaccggaaggtgcggctggatcacctcctttctaagga

SEQ ID NO: 5758 - DNA, 1530 bp, Micrococcus sp. HSID17228; identical to SEQ ID NO: 5757
  ref <308>: DATABASE ACCESSION NUMBER: NCBI ACCESSION: NZ_RBLO01000120.1
  ref <309>: DATABASE ENTRY DATE: 2019-04-01
  ref <313>: RELEVANT RESIDUES IN SEQ ID NO: (1)..(1530)

SEQ ID NO: 5759 - DNA, 1530 bp, Micrococcus sp. HSID17245
  ref <308>: DATABASE ACCESSION NUMBER: NCBI ACCESSION: NZ_RBLS01000138.1
  ref <309>: DATABASE ENTRY DATE: 2019-04-01
  ref <313>: RELEVANT RESIDUES IN SEQ ID NO: (1)..(1530)
tttacggagagtttgatcctggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactgggtctaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggggggagccgtcgaaggtgggaccagcgattgggactaagtcgtaacaaggtagccgtaccggaaggtgcggctggatcacctcctttctaagga

SEQ ID NO: 5760 - DNA, 1530 bp, Micrococcus sp. RIT608
  ref <308>: DATABASE ACCESSION NUMBER: NCBI ACCESSION: NZ_RJLX01000095.1
  ref <309>: DATABASE ENTRY DATE: 2019-04-01
  ref <313>: RELEVANT RESIDUES IN SEQ ID NO: (1)..(1530)
tttacggagagtttgatcctggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctacagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggtgggttcacaggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagctgtcgaaggtgggaccagcgattgggactaagtcgtaacaaggtagccgtaccggaaggtgcggctggatcacctcctttctaagga

SEQ ID NO: 5761 - DNA, 1500 bp, Microcoleus sp. PCC 7113
  ref <308>: DATABASE ACCESSION NUMBER: NCBI ACCESSION: NC_019738.1
  ref <309>: DATABASE ENTRY DATE: 2019-04-01
  ref <313>: RELEVANT RESIDUES IN SEQ ID NO: (1)..(1500)
aaaatggagagtttgatcctggctcaggatgaacgctggcggtctgcttaacacatgcaagtcgaacgggactcttcggagttcagtggcggacgggtgagtaacgcgtgagaatctgccttcaggtcggggacaaccactggaaacggtggctaataccggatatgccgcaacgtgaaagatttatcgcctgaagaggagctcgcgtctgattagctagttggtggggtaaaagctcaccaaggcgacgatcagtagctggtctgagaggatgatcagccacactgggactgagacacggcccagactcctacgggaggcagcagtggggaattttccgcaatgggcgaaagcctgacggagcaagaccgcgtgagggaggaaggctcttgggttgtaaacctcttttctcagggaagaacacaatgacggtacctgaggaatcagcctcggctaactccgtgccagcagccgcggtaatacggaggaggcaagcgttatccggaattattgggcgtaaagcgtccgcaggtggcacttcaagtctgtcgtcaaagactggggcttaaccctggaaaggcggtggaaactgaagcgctagagtgtggtagggggtagagggaattcccggtgtagcggtgaaatgcgtagagatcgggaagaacatcggtggcgaaagcgctctactggaccacaactgacactcagggacgaaagctaggggagcgaatgggattagataccccagtagtcctagccgtaaacgatggatactaggtgtggctcgtatcgacccgagccgtgccgtagctaacgcgttaagtatcccgcctggggagtacgctcgcaagagtgaaactcaaaggaattgacgggggcccgcacaagcggtggagtatgtggtttaattcgatgcaacgcgaagaaccttaccagggcttgacatgtccggaatcccagggaaacttgggagtgccttcgggagccggaacacaggtggtgcatggctgtcgtcagctcgtgtcgtgagatgttgggttaagtcccgcaacgagcgcaaccctcgtttttagttgccatcattaagttgggcactctagagagactgccagtgacaaactggaggaaggtggggatgacgtcaagtcagcatgccccttacgtcctgggctacacacgtactacaatgcgacggacaaagggcagcgagcgagcgatcgtcagctaatcccataaaccgtggctcagttcagatcgcaggctgcaactcgcctgcgtgaaggaggaatcgctagtaattgcaggtcagcatactgcagtgaattcgttcccgggccttgtacacaccgcccgtcacaccatgggagctggttttgcccgaagtcgttaccctaaccgcttgcggagggggacgccgaaggcagggctggtgactggggtgaagtcgtaacaaggtagccgtaccggaaggtgtggctggatcacctccttttaagggag

SEQ ID NO: 5762 - DNA, 1489 bp, Microcystis panniformis
  ref <308>: DATABASE ACCESSION NUMBER: NCBI ACCESSION: NZ_CP011339.1
  ref <309>: DATABASE ENTRY DATE: 2019-04-01
  ref <313>: RELEVANT RESIDUES IN SEQ ID NO: (1)..(1489)
atcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatgtgccgcaaggtgaaacctaattggcctggagaagagcttgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgccgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctcctta

SEQ ID NO: 5763 - DNA, 1494 bp, Microcystis sp. 0824
  ref <308>: DATABASE ACCESSION NUMBER: NCBI ACCESSION: NZ_BDSM01000045.1
  ref <309>: DATABASE ENTRY DATE: 2019-04-01
  ref <313>: RELEVANT RESIDUES IN SEQ ID NO: (1)..(1494)
atcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatatgccgcaaggtgaaacctaattggcctggagaagagcttgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgctgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctccttaaaggg

SEQ ID NO: 5764 - DNA, 1492 bp, Microcystis sp. MC19
  ref <308>: DATABASE ACCESSION NUMBER: NCBI ACCESSION: NZ_CP020664.1
  ref <309>: DATABASE ENTRY DATE: 2019-04-01
  ref <313>: RELEVANT RESIDUES IN SEQ ID NO: (1)..(1492)
atcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatatgccgcaaggtgaaacctaattggcctgaagaagagcttgcgtctgattagctagttggtggggtaaaggcctaccaaggcgacgatcagtagctggtctgagaggatgatcagccacactgggactgagacacggcccagactcctacgggaggcagcagtggggaatattccgcaatgggcgaaagcctgacgcagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgccgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagcatgtggtttaattcgatgcaacgcgaagaaccttaccaagacttgacatgtcgcgaaccctggtgaaagctgggggtgccttcgggagcgcgaacacaggtgctgcatggctgtcgtcagctcgtgtcgtgagatgttgggttaagtcccgcaacgagcgcaaccctcgttcttagttgccagcattaagttgggcactctaaggagactgccggtgacaagccggaggaaggtggggatgacgtcaagtcctcatggcccttacgtccagggctacacacgtgactacaatggtcggtgacaatgggcagcgatactcgcgagagccagcgaatcccagcaaacccggcctcagttcagattgcagtctgcaactcgcctgcatgaaggaggaatcgctagtaatcgccggtcagcatacggcggtgaatacgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctcctta

SEQ ID NO: 5765 - DNA, 1490 bp, Microcystis sp. T1-4
  ref <308>: DATABASE ACCESSION NUMBER: NCBI ACCESSION: NZ_CAIP01000212.1
  ref <309>: DATABASE ENTRY DATE: 2019-04-01
  ref <313>: RELEVANT RESIDUES IN SEQ ID NO: (1)..(1490)
atcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatatgccgcaaggtgaaacctaattggcctgaagaagagcttgcgtctgattagctagttggtggggtaaaggcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgccgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctccttaa

SEQ ID NO: 5766 - DNA, 1494 bp, Microcystis viridis
  ref <308>: DATABASE ACCESSION NUMBER: NCBI ACCESSION: NZ_AP019314.1
  ref <309>: DATABASE ENTRY DATE: 2019-04-01
  ref <313>: RELEVANT RESIDUES IN SEQ ID NO: (1)..(1494)
atcatggagagtttgatcctggctcaggatgaacgctggcggcgtgcctaacacatgcaagtcgaacgggaatcttcggattccagtggcggacgggtgagtaacgcgtaagaatctaacttcaggacggggacaacagttggaaacgactgctaatacccgatgtgccgcgaggtgaaacctaattggcctgaagaagagcttgcgtctgattagctagttggtggggtaaaggcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgctgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctccttaaaggg

SEQ ID NO: 5767 - DNA, 1554 bp, Micromonospora chalcea
  ref <308>: DATABASE ACCESSION NUMBER: NCBI ACCESSION: NZ_QNTW01000300.1
  ref <309>: DATABASE ENTRY DATE: 2019-04-01
  ref <313>: RELEVANT RESIDUES IN SEQ ID NO: (1)..(1554)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 5768 - DNA, 1525 bp, Micromonospora costi
  ref <308>: DATABASE ACCESSION NUMBER: NCBI ACCESSION: NZ_RBAN01000020.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccccgggaaaccggggctaataccggataggacctttcctcgcatgaggtttggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaaccggcagagatgtcgggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccgtaagggagggagccgtcgaaggtggggctggcgattgggacgaagtcgtaacaaggtagccgtaccggaaggtgcggctggatcacctcctttctaaggagca

SEQ ID NO: 5769 - DNA, 1227 bp, Micromonospora endolithica
  ref <308>: DATABASE ACCESSION NUMBER: NCBI ACCESSION: NZ_RBAK01000038.1
  ref <309>: DATABASE ENTRY DATE: 2019-04-01
  ref <313>: RELEVANT RESIDUES IN SEQ ID NO: (1)..(1227)
cggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcgcagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5770 - DNA, 1077 bp, Micromonospora globbae
  ref <308>: DATABASE ACCESSION NUMBER: NCBI ACCESSION: NZ_RAQQ01000096.1
  ref <309>: DATABASE ENTRY DATE: 2019-04-01
  ref <313>: RELEVANT RESIDUES IN SEQ ID NO: (1)..(1077)
aagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaaccggcagagatgtcgggtccttcgggggcggtcacaggtggtgcatggctgtcgtcagctcgtgtcgtgagatgttgggttaagtcccgcaacgagcgcaaccctcgttcgatgttgccagcggttcggccggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5771 - DNA, 1525 bp, Micromonospora globispora
  ref <308>: DATABASE ACCESSION NUMBER: NCBI ACCESSION: NZ_QGGF01000303.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccccgggaaaccggggctaataccgaataggactgctggtcgcatgactggtggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggaattattgggcgtaaagagctcgtaggcggcttgtcgcgtcgaccgtgaaaacttggggctcaaccccaagcctgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaaccggcagagatgtcgggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccgtaagggagggagccgtcgaaggtggggctggcgattgggacgaagtcgtaacaaggtagccgtaccggaaggtgcggctggatcacctcctttctaaggagca

SEQ ID NO: 5772 - DNA, 1525 bp, Micromonospora pisi
  ref <308>: DATABASE ACCESSION NUMBER: NCBI ACCESSION: NZ_RBKT01000001.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagtaacctgccctaggctttgggataaccctcggaaacgggggctaataccgaatatgacttctggccgcatggctgggggtggaaagttttttcggcttgggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgagagtgacggtacctgcagaagaagcaccggccaactacgtgccagcagccgcggtaagacgtagggtgcgagcgttgtccggatttattgggcgtaaagagctcgtaggcggcttgtcgcgtcgactgtgaaatcccgcggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggggacctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatgggcggaaatccggcagagatgtcgggtccttcggggccgttcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5773 - DNA, 1524 bp, Micromonospora sp. B006
  ref <308>: DATABASE ACCESSION NUMBER: NCBI ACCESSION: NZ_CP030865.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaggctttgggataaccccgggaaaccggggctaataccgaatatgaccttgcaccgcatggtgtttggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5774 - DNA, 1524 bp, Micromonospora sp. BL-1; identical to SEQ ID NO: 5773
  ref <308>: DATABASE ACCESSION NUMBER: NCBI ACCESSION: NZ_RCVK01000090.1
  ref <309>: DATABASE ENTRY DATE: 2019-04-01
  ref <313>: RELEVANT RESIDUES IN SEQ ID NO: (1)..(1524)

SEQ ID NO: 5775 - DNA, 1526 bp, Micromonospora sp. BL-4
  ref <308>: DATABASE ACCESSION NUMBER: NCBI ACCESSION: NZ_RCVJ01000228.1
  ref <309>: DATABASE ENTRY DATE: 2019-04-01
  ref <313>: RELEVANT RESIDUES IN SEQ ID NO: (1)..(1526)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaagctttgggataaccccgggaaaccggggctaataccggatattacttggccttgcatgaggttgggtggaaagtttttcggcttgggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcaccggccaactacgtgccagcagccgcggtaagacgtagggtgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcgcagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaaccccttgtgggagggagccgtcgaaggtggggctggcgattgggacgaagtcgtaacaaggtagccgtaccggaaggtgcggctggatcacctcctttctaaggagca

SEQ ID NO: 5776 - DNA, 1526 bp, Micromonospora sp. CV-4; identical to SEQ ID NO: 5775
  ref <308>: DATABASE ACCESSION NUMBER: NCBI ACCESSION: NZ_RCVI01000124.1
  ref <309>: DATABASE ENTRY DATE: 2019-04-01
  ref <313>: RELEVANT RESIDUES IN SEQ ID NO: (1)..(1526)

SEQ ID NO: 5777 - DNA, 1528 bp, Micromonospora sp. HM5-17
  ref <308>: DATABASE ACCESSION NUMBER: NCBI ACCESSION: NZ_RJWA01000024.1
  ref <309>: DATABASE ENTRY DATE: 2019-04-01
  ref <313>: RELEVANT RESIDUES IN SEQ ID NO: (1)..(1528)
tgttggagagtttgatcctggctcaggacgaacgctggcggcgtgcttaacacatgcaagtcgagcggaaaggcccttcggggtactcgagcggcgaacgggtgagtaacacgtgagtaacctgccctaggctttgggataaccccgggaaaccggggctaataccggatatgacctggtgccgcatggtgttgggtggaaagttttttcggcctgggatgggctcgcggcctatcagcttgttggtggggtgatggcctaccaaggcgatgacgggtagccggcctgagagggcgaccggccacactgggactgagacacggcccagactcctacgggaggcagcagtggggaatattgcacaatgggcggaagcctgatgcagcgacgccgtgtgagggatgaaggccttcgggttgtaaacctctttcagcagggacgaagcgtgagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcggcttaactgtgggcttgcagtcgatacgggcgggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggtttcctgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaacctgcagagatgtggggtccttcgggggcggtcacaggtggtgcatggctgtcgtcagctcgtgtcgtgagatgttgggttaagtcccgcaacgagcgcaacccttgttcgatgttgccagcacgtgatggtggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaatgctgcggtgaatacgttcccgggccttgtacacaccgcccgtcacgtcacgaaagtcggcaacacccgaagccggtggcctaacccctgtttggggagggagctgtcgaaggtggggctggcgattgggacgaagtcgtaacaaggtagccgtaccggaaggtgcggctggatcacctcctttctaaggagc

SEQ ID NO: 5778 - DNA, 1524 bp, Micromonospora sp. LB19
  ref <308>: DATABASE ACCESSION NUMBER: NCBI ACCESSION: NZ_QDGB01000087.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaagctttgggataaccctcggaaacgggggctaataccgaatattacttctggccgcatggctggtggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgagagtgacggtacctgcagaagaagcaccggccaactacgtgccagcagccgcggtaagacgtagggtgcgagcgttgtccggatttattgggcgtaaagagctcgtaggcggcttgtcgcgtcgaccgtgaaaacttggggctcaactccaagcctgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggtttcctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcacagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5779 - DNA, 1524 bp, Micromonospora sp. LB32
  ref <308>: DATABASE ACCESSION NUMBER: NCBI ACCESSION: NZ_QGSY01000327.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaagctttgggataaccctcggaaacgggggctaataccgaatattacttctggccgcatggctggtggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgagagtgacggtacctgcagaagaagcaccggccaactacgtgccagcagccgcggtaagacgtagggtgcgagcgttgtccggatttattgggcgtaaagagctcgtaggcggcttgtcgcgtcgaccgtgaaaacttggggctcaactccaagcctgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcgcagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5780 - DNA, 1524 bp, Micromonospora sp. LB39
  ref <308>: DATABASE ACCESSION NUMBER: NCBI ACCESSION: NZ_QGSZ01000055.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaagctttgggataaccctcggaaacgggggctaataccgaatattactgctggccgcatggttggtggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgagagtgacggtacctgcagaagaagcaccggccaactacgtgccagcagccgcggtaagacgtagggtgcgagcgttgtccggatttattgggcgtaaagagctcgtaggcggcttgtcgcgtcgaccgtgaaaacttggggctcaaccccaagcctgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaacctccagagatggggggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5781 - DNA, 1524 bp, Micromonospora sp. LB41
  ref <308>: DATABASE ACCESSION NUMBER: NCBI ACCESSION: NZ_QGTA01000013.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaggctttgggataaccccgggaaaccggggctaataccggatatgaccttgcaccgcatggtgtttggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgaccgtgaaaacctggggctcaaccccaggcctgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5782 - DNA, 1525 bp, Micromonospora sp. Llam0
  ref <308>: DATABASE ACCESSION NUMBER: NCBI ACCESSION: NZ_RJJY01000001.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagcaacctgccccaggctttgggataaccccgggaaaccggggctaataccggatattacatgctgccgcatggtggtgtgtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccacagctcaactgtgggcttgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggagcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaacctgcagagatgtggggtccttcgggggcggtcacaggtggtgcatggctgtcgtcagctcgtgtcgtgagatgttgggttaagtcccgcaacgagcgcaacccttgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaaccccttgtgggagggagctgtcgaaggtggggctggcgattgggacgaagtcgtaacaaggtagccgtaccggaaggtgcggctggatcacctcctttctaaggagc

SEQ ID NO: 5783 - DNA, 1525 bp, Micromonospora sp. M71 S20
  ref <308>: DATABASE ACCESSION NUMBER: NCBI ACCESSION: NZ_RCCV01000001.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccccgggaaaccggggctaataccgaataggaccaccggtcgcatggttggtggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcgcagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggcaggaaggtggggatgacgtcaagtcatcatgccccttatgtccagggcttcacgcatgctacaatggccggtacaatgggctgcgattaccgtgaggtggagcgaatcccaaaaagccggtctcagttcggatcggggtctgcaactcgaccccgtgaagtcggagtcgctagtaatcgcagatcagcaacgctgcggtgaatacgttcccggccttgtacacaccgcccgtcacgtcacgaaagtcggcaacacccgaagccggtggcccaacccttgtgggagggagccgtcgaaggtggggctggcgattgggacgaagtcgtaacaggtagccgtaccggaaggtgcggctggatcacctcctttctaaggagca

SEQ ID NO: 5784 - DNA, 1524 bp, Micromonospora sp. MS1-9
  ref <308>: DATABASE ACCESSION NUMBER: NCBI ACCESSION: NZ_RAZT01000031.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccgaataggaccttgccttgcatgaggcttggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcaccggccaactacgtgccagcagccgcggtaagacgtagggtgcgagcgttgtccggatttattgggcgtaaagagctcgtaggcggcttgtcgcgtcgactgtgaaaacccgcggctcaaccgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggagcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcgcagagatgtgaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtaaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5785 - DNA, 1524 bp, Micromonospora sp. MW-13
  ref <308>: DATABASE ACCESSION NUMBER: NCBI ACCESSION: NZ_QKKX01000104.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccggataagacttctgaccgcatggttgggggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcaccggccaactacgtgccagcagccgcggtaagacgtagggtgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactcacagagatgtggggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 5786 - DNA, 1524 bp, Micromonospora sp. NGC1-4; identical to SEQ ID NO: 5784
  ref <308>: DATABASE ACCESSION NUMBER: NCBI ACCESSION: NZ_RAZS01000026.1
  ref <309>: DATABASE ENTRY DATE: 2019-04-01
  ref <313>: RELEVANT RESIDUES IN SEQ ID NO: (1)..(1524)

SEQ ID NO: 5787 - DNA, 1526 bp, Micromonospora sp. PPF5-17
  ref <308>: DATABASE ACCESSION NUMBER: NCBI ACCESSION: NZ_RJLN01000160.1
  ref <309>: DATABASE ENTRY DATE: 2019-04-01
  ref <313>: RELEVANT RESIDUES IN SEQ ID NO: (1)..(1526)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccccgggaaaccggggctaataccgaatatgacttctggtcgcatgactggtggtggaaagtttttcggcctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcagctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttccctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaaccccttgtgggagggagccgtcgaaggtggggctggcgattgggacgaagtcgtaacaaggtagccgtaccggaaggtgcggctggatcacctcctttctaaggagca

SEQ ID NO: 5788 - DNA, 1534 bp, Micromonosporaceae bacterium CPCC 204380
  ref <308>: DATABASE ACCESSION NUMBER: NCBI ACCESSION: NZ_QJUG01000355.1
  ref <309>: DATABASE ENTRY DATE: 2019-04-01
  ref <313>: RELEVANT RESIDUES IN SEQ ID NO: (1)..(1534)
tgttggagagtttgatcctggctcaggacgaacgctggcggcgtgcttaacacatgcaagtcgaacggaaaggccccttcgggggtgctcgagtggcgaacgggtgagtaacacgtgagtaacctgccccaatctttgggataaccttcggaaacgggggctaataccggatattcccttctggtcgcatggctggtgggggaaagtttttcgggttgggttgggctcgcggcctatcagcttgttggtggggtgatggcttaccaaggctttgacgggtagccggcctgagagggcgaccggccacactgggactgagacacggcccagactcctacgggaggcagcagtggggaatattgcacaatggacggaagtctgatgcagcgacgccgcgtgggggatgacggccttcgggttgtaaacccctttcgtcagggacgaagccttttggggtgacggtacctggagaagaagcgccggccaactacgtgccagcagccgcggtaagacgtagggcgcgagcgttgtccggatttattgggcgtaaagagctcgtaggcggtccattgcgtctgccgtgaaaacctgcagcttaactgtgggcttgcggttgatacgggtgggctggagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggtttcctgcgccgtagctaacgcattaagcgccccgcctggggagtacggccgcaaggctaaaactcaaaggaattgacgggggcccgcacaagcggcggagcatgcggattaattcgatgcgacgcgaagaaccttacctgggtttgacatcgccggtaatcccacagagatgtggggtccttcggggccggtgacaggtggtgcatggctgtcgtcagctcgtgtcgtgagatgttgggttaagtcccgcaacgagcgcaaccctcgttccatgttgccagcgggttatgccggggactcatgggagactgccggggtcaactcggaggaaggtggggatgacgtcaagtcatcatgccccttatgtccagggcttcacgcatgctacaatggccggtacaatgggctgcgatactgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagcccatggcccaaccccgtgaggggagggagtggtcgaaggtggggctggcgattgggacgaagtcgtaacaaggtagccgtaccggaaggtgcggctggatcacctcctttctaaggagca

SEQ ID NO: 5789 - DNA, 1506 bp, Microscilla marina
  ref <308>: DATABASE ACCESSION NUMBER: NCBI ACCESSION: NZ_AAWS01000090.1
  ref <309>: DATABASE ENTRY DATE: 2019-04-01
  ref <313>: RELEVANT RESIDUES IN SEQ ID NO: (1)..(1506)
tttacaatggagagtttgatcctggctcaggatgaacgctagcggcaggcctaatacatgcaagtcgaacgagaccttcgggtctagtggcgcacgggtgcgtaacgcgtatgcaacttacctcttactggggaataacttcgcgaaagtggagctaataccgcataataaacgataaggcatcttattgttttaaaaggttacggtaggagatgggcatgcgtcccattagctagttggtagggtaatggcttaccaaggcaacgatgggtaggggaactgagaggttgatcccccacactggtactgagatacggaccagactcctacgggaggcagcagtaaggaatattggtcaatggacgagagtctgaaccagccatgccgcgtgcaggaagaaggcgttacgcgtcgtaaactgcttttatataggaagaaaagttttctgcggaaaagattgacggtactatatgaataagcaccggctaactacgtgccagcagccgcggtaatacgtagggtgcaagcgttgtccggatttattgggtttaaagggtgcgtaggcggaagcttaagtcttgggtgaaatcccaccgctcaacggtggaactgcctgagaaactgggtttcttgagtatagttgaggtagctggaattggtggtgtagcggtgaaatgcatagataccaccaggaacacctattgcgaaggcaagctactaagctataactgacgctgaggcacgaaagcgtggggagcgaacaggattagataccctggtagtccacgccgtaaacgatgatgactcgctgctggcgatacacagtcagtggctaagggaaaccgttaagtcatccacctggggagtacgaccgcaaggttgaaactcaaaggaattgacgggggtccgcacaagcggtggagcatgtggtttaattcgatgatacgcgaggaaccttacctgggctagaatgcgagggaatgtactagaaatggtacagtcttcggacccgaagcaaggtgctgcatggctgtcgtcagctcgtgccgtgaggtgttgggttaagtcccgcaacgagcgcaacccctatgatcagttgccatcagataaagctggggactctggtcagactgcctgcgcaagcggagaggaaggtggggacgacgtcaagtcatcatggcccttacgcccagggctacacacgtgctacaatggaagatacaacgggtagctacttagtaataagatgccaatctccaaagtctttcacagttcggattgaggtctgcaactcgaccttatgaagttggaatcgctagtaatcgcgcatcagcaatggcgcggtgaatacgttcccggaccttgtacacaccgcccgtcaagccatgggagttgggtggacctgaagacggtgtttcaacatcgtttagggttaaaccagcgactggggctaagtcgtaacaaggtagccgtaccggaaggtgtggctggaacacctcctttcta

SEQ ID NO: 5790 - DNA, 1531 bp, Microterricola sp. OV434
  ref <308>: DATABASE ACCESSION NUMBER: NCBI ACCESSION: NZ_RAQA01000006.1
  ref <309>: DATABASE ENTRY DATE: 2019-04-01
  ref <313>: RELEVANT RESIDUES IN SEQ ID NO: (1)..(1531)
tttacggagagtttgatcctggctcaggacgaacgctggcggcgtgcttaacacatgcaagtcgaacgatgaaagagggagcttgcttcttctggattagtggcgaacgggtgagtaacacgtgagcaatctgcccttgactctgggataagcgttggaaacgacgtctaataccggatacgaccctcggaggcatctcctgggggtggaaagaattttggtcaaggatgagctcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaagacttgacatatacgagaacgggccagaaatggtcaactctttggacactcgtaaacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccccttgtgggaaggagctgtcgaaggtgggatcggtgattaggactaagtcgtaacaaggtagccgtaccggaaggtgcggctggatcacctcctttcta

SEQ ID NO: 5791 - DNA, 1485 bp, Microvirga flocculans
  ref <308>: DATABASE ACCESSION NUMBER: NCBI ACCESSION: NZ_JAEA01000030.1
  ref <309>: DATABASE ENTRY DATE: 2019-04-01
  ref <313>: RELEVANT RESIDUES IN SEQ ID NO: (1)..(1485)
ttcaacttgagagtttgatcctggctcagaacgaacgctggcggcaggcttaacacatgcaagtcgaacgcatccttcggggtgagtggcagacgggtgagtaacgcgtgggaacgtgcccttcagttcgggataacccagggaaacttgggctaataccggatacgtgcgagagcagaaagatttatcgctgaaggatcggcccgcgtctgattagctggttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctctttcgtccgggacgataatgacggtaccggaagaagaagccccggctaacttcgtgccagcagccgcggtaatacgaagggggctagcgttgttcggaatcactgggcgtaaagggcgcgtaggcggctttgtaagtcgggggtgaaagcctgtggctcaaccacagaattgccttcgatactgcgaggcttgagaccggaagaggttagtggaactgcgagtgtagaggtgaaattcgtagatattcgcaagaacaccagtggcgaaggcggctgactggtccggatctgacgctgaggcgcgaaagcgtggggagcaaacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtcccgtatggattttggagacaggatccttcagttcggctggcgggaacacaggtgctgcatggctgtcgtcagctcgtgtcgtgagatgttgggttaagtcccgcaacgagcgcaaccctcgcccctagttgccatcattgagttgggcactctagggggactgccggtgataagccgcgaggaaggtggggatgacgtcaagtcctcatggcccttacgggctgggctacacacgtgctacaatggcggtgacaatgggcagcgaacccgcgagggggagctaatcctcaaaagccgtctcagttcggattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctc

SEQ ID NO: 5792 - DNA, 1500 bp, Microvirga lotononidis
  ref <308>: DATABASE ACCESSION NUMBER: NCBI ACCESSION: NZ_JH660642.1
  ref <309>: DATABASE ENTRY DATE: 2019-04-01
  ref <313>: RELEVANT RESIDUES IN SEQ ID NO: (1)..(1500)
aattcttcaacttgagagtttgatcctggctcagaacgaacgctggcggcaggcttaacacatgcaagtcgaacgggcccttcggggtcagtggcagacgggtgagtaacgcgtgggaacgtgcccttcagtttggaataacccagggaaacttgggctaataccggatacgcccgcaaggggaaagatttatcgctgaaggatcggcccgcgtctgattagctggttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcgcacgcgacgataatgacggtagcgtgagaagaagccccggctaacttcgtgccagcagccgcggtaatacgaagggggctagcgttgttcggaatcactgggcgtaaagggcgcgtaggcggctttgtaagtcgggggtgaaagcctgtggctcaaccacagaattgccttcgatactgcatggcttgagaccggaagaggttagtggaactgcgagtgtagaggtgaaattcgtagatattcgcaagaacaccagtggcgaaggcggctgactggtccggatctgacgctgaggcgcgaaagcgtggggagcaaacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtcccgtatgaggagtggagacacgcctcttcagttcggctggcgggaacacaggtgctgcatggctgtcgtcagctcgtgtcgtgagatgttgggttaagtcccgcaacgagcgcaaccctcgcccctagttgccatcattgagttgggcactctagggggactgccggtgataagccgcgaggaaggtggggatgacgtcaagtcctcatggcccttacgggctgggctacacacgtgctacaatggcggtgacaaagggcagcgaacccgcgagggggagctaatcctcaaaagccgtctcagttcggattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagg

SEQ ID NO: 5793 - DNA, 1492 bp, Microvirga massiliensis
  ref <308>: DATABASE ACCESSION NUMBER: NCBI ACCESSION: NZ_CAHM01000373.1
  ref <309>: DATABASE ENTRY DATE: 2019-04-01
  ref <313>: RELEVANT RESIDUES IN SEQ ID NO: (1)..(1492)
tctaagttgagagtttgatcctggctcagagcgaacgctggcggcaggcttaacacatgcaagtcgaacgcatccttcgggatgagtggcagacgggtgagtaacacgtgggaacgtgccttctggttcggaataacccagggaaacttgggctaataccggatacgcccttacggggaaagatttatcgccggaagatcggcccgcgtctgattagcttgttggtggggtaatggcccaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgcacgcgacgataatgacggtagcgtgagaagaagccccggctaacttcgtgccagcagccgcggtaatacgaagggggctagcgttgctcggaatcactgggcgtaaagggcgcgtaggcggccggccaagtcgggggtgaaagcctgtggctcaaccacagaatggccctcgatactggacggctcgagaccggaagaggttggtggaattgcgagtgtagaggtgaaattcgtagatattcgcaagaacaccggtggcgaaggcggccaactggtccggatctgacgctgaggcgcgaaagcgtggggagcaaacaggattagataccctggtagtccacgccgtaaacgatggatgccagccgttggcgcgcttgcgcgtcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccaacctttgacatgtccagtatggggaccagagatggaccccttcagttcggctggctggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgcgaggaaggtggggatgacgtcaagtcctcatggcccttacaggttgggctacacacgtgctacaatggcggtgacaatgggcagcgaaggggcgacctggagctaatcccaaaaagccgtctcagttcagattgcactctgcaactcgggtgcatgaaggcggaatcgctagtaatcgtggatcagaacgccacggtgaatacgttcccgggccttgtacacaccgcccgtcacaccatgggagttggttttacccgacggcgctgtgccaaccgcaaggaggcaggcgaccacggtagggtcagcgactggggtgaagtcgtaacaaggtagccgtaggggaacctgcggctggatcacctcctttcta

SEQ ID NO: 5794 - DNA, 1493 bp, Microvirga sp. 17 mud 1-3
  ref <308>: DATABASE ACCESSION NUMBER: NCBI ACCESSION: NZ_CP029481.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgaacgcatccttcggggtgagtggcagacgggtgagtaacgcgtgggaacgtgcccttcagttcggaataacccagggaaacttgggctaataccggatacgtgcgagagcagaaagatttatcgctgaaggatcggcccgcgtctgattagctagttggtgaggtaaaggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcggcggggacgataatgacggtacccgcagaagaagccccggctaacttcgtgccagcagccgcggtaatacgaagggggctagcgttgttcggaatcactgggcgtaaagggcgcgtaggcggctttataagtcgggggtgaaagcctgtggctcaaccacagaattgccttcgatactgtagagcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacaggattagataccctggtagtccacgccgtaaacgatgaatgccagccgttgggcagcttgctgctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtccggtttggggagtggagacacaccccttcagttcggctggccggaacacaggtgctgcatggctgtcgtcagctcgtgtcgtgagatgttgggttaagtcccgcaacgagcgcaaccctcgcctttagttgccatcatttagttgggcactctaaagggactgccggtgataagccgagaggaaggtggggatgacgtcaagtcctcatggcccttacgggctgggctacacacgtgctacaatggcggtgacaatgggcagcgaacccgcgagggggagctaatcccaaaaagccgtctcagttcggattgcactctgcaactcgagtgcatgaaggtggaatcgctagtaatcgtggatcagaatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaag

SEQ ID NO: 5795 - DNA, 854 bp, Microvirga sp. BSC39
  ref <308>: DATABASE ACCESSION NUMBER: NCBI ACCESSION: NZ_JPUG01000054.1
  ref <309>: DATABASE ENTRY DATE: 2019-04-01
  ref <313>: RELEVANT RESIDUES IN SEQ ID NO: (1)..(854)
aattcttcaacttgagagtttgatcctggctcagaacgaacgctggcggcaggcttagcacatgcaagtcgaacgcatccttcggggtgagtggcagacgggtgagtaacgcgtgggaacgtgcccttcagttcggaataacccagggaaacttgggctaataccggatacgtgcgagagcagaaagatttatcgctgaaggatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcggcggggacgataatgacggtacccgcagaagaagccccggctaacttcgtgccagcagccgcggtaatacgaagggggctagcgttgttcggaatcactgggcgtaaagggcgcgtaggcggctttataagtcgggggtgaaagcctgtggctcaaccacagaattgccttcgatactgtatggcttgagaccggaagaggttagtggaactgcgagtgtagaggtgaaattcgtagatattcgcaagaacaccagtggcgaaggcggctgactggtccggttctgacgctgaggcgcgaaagcgtggggagcaaacaggattagataccctggtagtccacgccgtaaacgatgaatgccagccgttgggcagcttgctgctcagtggcgcagctaacgctttaagcattccgcctggggagtacggtcgcaagatt

SEQ ID NO: 5796 - DNA, 1552 bp, Microvirga sp. CCBAU 65841
  ref <308>: DATABASE ACCESSION NUMBER: NCBI ACCESSION: NZ_QDGA01000235.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 5797 - DNA, 1496 bp, Microvirga sp. KLBC 81
  ref <308>: DATABASE ACCESSION NUMBER: NCBI ACCESSION: NZ_QDAH01000157.1
  ref <309>: DATABASE ENTRY DATE: 2019-04-01
  ref <313>: RELEVANT RESIDUES IN SEQ ID NO: (1)..(1496)
ctcttcaacttgagagtttgatcctggctcagaacgaacgctggcggcaggcttaacacatgcaagtcgaacgcacccttcggggtgagtggcagacgggtgagtaacgcgtgggaacgtgcccttcagttcggaataacccagggaaacttgggctaataccggatacgtccgagaggagaaagattgatcgctgaaggatcggcccgcgtctgattagctggttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcggcggggacgataatgacggtacccgcagaagaagccccggctaacttcgtgccagcagccgcggtaatacgaagggggctagcgttgttcggaatcactgggcgtaaagggcgcgtaggcggctttgtaagtcgggggtgaaagcctgtggctcaaccacagaattgccttcgatactgcatggcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtccggtatgggggccagagatggcttccttcagttcggctggccggaacacaggtgctgcatggctgtcgtcagctcgtgtcgtgagatgttgggttaagtcccgcaacgagcgcaaccctcgcccctagttgccatcattcagttgggcactctagggggactgccggtgataagccgcgaggaaggtggggatgacgtcaagtcctcatggcccttacgggctgggctacacacgtgctacaatggcggtgacaatgggcagccaacccgcgagggggcgctaatcccaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaa

SEQ ID NO: 5798 - DNA, 1493 bp, Microvirga vignae
  ref <308>: DATABASE ACCESSION NUMBER: NCBI ACCESSION: NZ_LCYG01000082.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcaggcttaacacatgcaagtcgaacgggcccttcggggtcagtggcagacgggtgagtaacgcgtgggaacgtgcccttcagttcggaataacccagggaaacttgggctaataccggatacgtccgtaaggagaaagatttatcgctgaaggatcggcccgcgtctgattagctggttggtagggtaatggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcggcggggacgataatgacggtacccgcagaagaagccccggctaacttcgtgccagcagccgcggtaatacgaagggggctagcgttgttcggaatcactgggcgtaaagggcgcgtaggcggctttgtaagtcgggggtgaaagcctgtggctcaaccacagaattgccttcgatactgcatggcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtcccgtgtggatcctggagacaggatccttcagttcggctggcgggaacacaggtgctgcatggctgtcgtcagctcgtgtcgtgagatgttgggttaagtcccgcaacgagcgcaaccctcgcccctagttgccatcattgagttgggcactctagggggactgccggtgataagccgcgaggaaggtggggatgacgtcaagtcctcatggcccttacgggctgggctacacacgtgctacaatggcggtgacaatgggcagccaacccgcgagggtgcgctaatcccaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5799 - DNA, 1497 bp, Minwuia thermotolerans
  ref <308>: DATABASE ACCESSION NUMBER: NCBI ACCESSION: NZ_PIGG01000020.1
  ref <309>: DATABASE ENTRY DATE: 2019-04-01
  ref <313>: RELEVANT RESIDUES IN SEQ ID NO: (1)..(1497)
aaacttgagagtttgatcctggctcagaacgaacgctggcggcaggcctaacacatgcaagtcgagcgcccccttcggggggagcggcgaacgggtgagtaacgcgtgggaacgtaccgatcggtctgggacaaccccgggaaactggggctaataccggatgcgctctacggaggaaagatttatcgccgattgatcggcccgcgttggattagcttgttggtgaggtaacggctcaccaaggcgacgatccatagctggtctgagaggatgatcagccacactgggactgagacacggcccagactcctacgggaggcagcagtggggaatcttggacaatgggcgaaagcctgatccagccatgccgcgtgagtgaagaaggccttagggttgtaaagctctttcagcggggacgataatgacggtacccgcagaagaagccccggctaactccgtgccagcagccgcggtaagacggagggggctagcgttgttcggaattactgggcgtaaagcgcgcgtaggcggcgcgttaagtcagaggtgaaagcccggggctcaaccccggaacagcctttgagactggcgtgcttgagtgcgggagaggtgagtggaattcccagtgtagaggtgaaattcgtagatattgggaagaacaccagtggcgaaggcggctcactggcccgtaactgacgctgaggtgcgaaagcgtggggagcaaacaggattagataccctggtagtccacgccgtaaacgatgagagctagtcgtcggggcgcttgcgcttcggtgacgcagttaacgcattaagctctccgcctggggagtacggccgcaaggttaaaactcaaaggaattgacgggggcccgcacaagcggtggagcatgtggtttaattcgaagcaacgcgcagaaccttaccagctcttgacatcccgatcgcggggaccggagacggaccccttcagttcggctggatcggtgacaggtgctgcatggctgtcgtcagctcgtgtcgtgagatgttgggttaagtcccgcaacgagcgcaacccttgccttcagttgccatcggttcggccgggcactctggaggaactgccggtgacaagccggaggaaggtggggatgacgtcaagtcctcatggcccttacgggctgggctacacacgtgctacaatggcggtgacagtgggcagcgaaggggcgacctggagcgaatccccaaaaaccgtctcagttcggattgttctctgcaactcgagagcatgaagttggaatcgctagtaatcgcggaacagcatgccgcggtgaatacgttcccgggccttgtacacaccgcccgtcacaccatgggagttggcttgacccgaagacggtgcgctaacctgcttgcaggaggcagccggccacggtcaggtcagcgactggggtgaagtcgtaacaaggtagccgtaggggaacctgcggctggatcacctcctttctaagg

SEQ ID NO: 5800 - DNA, 1658 bp, Mitsuokella jalaludinii
  misc_feature (584)..(584): n is a, c, g, or t
  ref <308>: DATABASE ACCESSION NUMBER: NCBI ACCESSION: NZ_CYYU01000007.1
  ref <309>: DATABASE ENTRY DATE: 2019-04-01
  ref <313>: RELEVANT RESIDUES IN SEQ ID NO: (1)..(1658)
tttatggagagtttgatcctggctcaggacgaacgctggcggcgtgcttaacacatgcaagtcgtacgaggcagattttcatcactgaactttaaagagcggactgatgagaggcgtcgtgaatgcgaagcattcaccacacttttataaagtgcttaactttaaggctgagtgatgaaaagatgccgagtggcaaacgggtgagtaacgcgtagacaacctgccgtaaagatggggacaacagttcgaaaggactgctaataccgaatgttgtcgaacttccgcatggaagctcgactaaagatggcctctacttgtaagctatcgctttacgatgggtctgcgtctgattagctagttggtggggtaacggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttncaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaaggactagagatagtcccctctcttcggagacacgaaaacaggtggtgcatggctgtcgtcagctcgtgtcgtgagatgttgggttaagtcccgcaacgagcgcaacccctatcctttgttgccagcacgcaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcacctcctttctaagga

SEQ ID NO: 5801 - DNA, 1623 bp, Mitsuokella multacida
  ref <308>: DATABASE ACCESSION NUMBER: NCBI ACCESSION: NZ_QRHE01000006.1
  ref <309>: DATABASE ENTRY DATE: 2019-04-01
  ref <313>: RELEVANT RESIDUES IN SEQ ID NO: (1)..(1623)
ctggcggcgtgcttaacacatgcaagtcgtacgaggcagattttcatcactgaactttaaagagtggactgatgagaagcgtcgtgaatgcgaagcattcaccacacttttataaagtgcttaactttaaggctgagtgatgaaaagatgccgagtggcaaacgggtgagtaacgcgtagataacctgccgtaaagatggggacaacagtccgaaaggactgctaataccgaatgttgtggaacttccgcatgggagctctactaaagatggcctctacttgtaagctatcgctttacgatgggtctgcgtctgattagctagttggtggggtaacggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtgaggacggcgaatagccgttttcaatgacggtacctgacgaggaagccacggctaactacgtgccagcagccgcggtaatacgtaggtggcgagcgttgtccggaattattgggcgtaaagggagcgcaggcgggaggtcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaaggactagagatagttccctctcttcggagacacgaaaacaggtggtgcatggctgtcgtcagctcgtgtcgtgagatgttgggttaagtcccgcaacgagcgcaacccctatcctttgttgccagcacgtaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcacctcctttctaagga

SEQ ID NO: 5802 - DNA, 1570 bp, Mitsuokella sp. AF21-1AC
  ref <308>: DATABASE ACCESSION NUMBER: NCBI ACCESSION: NZ_QRVW01000007.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcttaacacatgcaagtcgtacgaggtgaattgaaagcttgcttttgatgaaccgagtggcaaacgggtgagtaacgcgtagacaacctgccgcaaagatggggacaacagtccgaaaggactgctaataccgaatgttgtgagattcctgcatgggaacttcattaaagatggcctctacttgtaagctatcgctttgcgatgggtctgcgtctgattagatagttggcggggtaacggcccaccaagtcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaacgtggagacggcaaacagtcgtttccaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagccaggggagcgaacgggattagataccccggtagtcctggccgtaaacgatgaatactaggtgtaggaggtatcgaccccttctgtgccggagttaacgcaataagtattccgcctggggagtacggccgcaaggctgaaactcaaaggaattgacgggggcccgcacaagcggtggagtatgtggtttaattcgacgcaacgcgaagaaccttaccagggcttgacattgagtgaaagagctagagatagctccctctcttcggagacacgaaaacaggtggtgcatggctgtcgtcagctcgtgtcgtgagatgttgggttaagtcccgcaacgagcgcaacccctatcttctgttgccagcacgtaatggtgggaactcaggagagactgccgcggagaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggtgggctaaccgcaagggagcagccgtctaaggtgggggcgatgactggggtgaagtcgtaacaaggtagccgtatcggaaggtgcggctggatcacctcctttctaagga

SEQ ID NO: 5803 - DNA, 1566 bp, Mitsuokella sp. AF33-22
  ref <308>: DATABASE ACCESSION NUMBER: NCBI ACCESSION: NZ_QRQA01000005.1
  ref <309>: DATABASE ENTRY DATE: 2019-04-01
  ref <313>: RELEVANT RESIDUES IN SEQ ID NO: (1)..(1566)
tttatggagagtttgatcctggctcaggacgaacgctggcggcgtgcttaacacatgcaagtcgtacgaggtgaattgaaagcttgcttttgatgaaccgagtggcaaacgggtgagtaacgcgtagacaacctgccgcaaagatggggacaacagtccgaaaggactgctaataccgaatgttgtgagattcccgcatggggacctcattaaagatggcctctacttgtaagctatcgctttgcgatgggtctgcgtctgattagatagttggcggggtaacggcccaccaagtcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaacgtggagatggcaaatagccgtttccaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagccaggggagcgaacgggattagataccccggtagtcctggccgtaaacgatgaatactaggtgtaggaggtatcgaccccttctgtgccggagttaacgcaataagtattccgcctggggagtacggccgcaaggctgaaactcaaaggaattgacgggggcccgcacaagcggtggagtatgtggtttaattcgacgcaacgcgaagaaccttaccagggcttgacattgagtgaaagggctagagatagctccctctcttcggagacacgaaaacaggtggtgcatggctgtcgtcagctcgtgtcgtgagatgttgggttaagtcccgcaacgagcgcaacccctatcttctgttgccagcacgtaaaggtgggaactcaggagagactgccgcggagaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggtgggctaaccgcaagggagcagccgtctaaggtgggggcgatgactggggtgaagtcgtaacaaggtagccgtatcggaaggtgcggctggatcacctcctttcta

SEQ ID NO: 5804 - DNA, 1568 bp, Mitsuokella sp. oral taxon 131
  ref <308>: DATABASE ACCESSION NUMBER: NCBI ACCESSION: NZ_KI273068.1
  ref <309>: DATABASE ENTRY DATE: 2019-04-01
  ref <313>: RELEVANT RESIDUES IN SEQ ID NO: (1)..(1568)
ttcctaggagagtttgatcctggctcaggacgaacgctggcggcgtgcttaacacatgcaagtcgaacgagacggattgggagcttgctcctgacaagtcgagtggcaaacgggtgagtaacgcgtagacaacctgccgcaaagatggggacaacagcccgaaagggctgctaataccgaatgttgcgcccctcccgcatgggaggggcgccaaagatggcctctgcctgcaagccatcgctttgcgatgggtctgcgcctgattagccagttggcggggcaacggcccaccaaggcgacgatcagtagccggtctgagaggatggacggccacattgggactgagacacggcccagactcctacgggaggcagcagtggggaatcttccgcaatgggcgaaagcctgacggagcaacgccgcgtgggtgaagaaggtcttcggatcgtaaagccctgttgcccgggacgaacgcccccggcgcgaacagcgccggggggtgacggtaccgggcgaggaagccacggccaactacgtgccagcagccgcggtaatacgtaggtggcgagcgttgtccggaatcattgggcgtaaagggagcgcaggcgggcatgcaagtccatcttaaaagcgcggggcccaaccccgcgaggggatggaaactgcgtgccttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatgaatgctaggtgtggggggtatcgacccctcccgtgccggagtcaacgcaataagcattccgcctggggagtacggccgcaaggctgaaactcaaaggaattgacgggggcccgcacaagcggtggagtatgtggttcaattcgacgcaacgcgaagaaccttaccagggcttgacattgagtgaaagggccggagacggccccctcccctcggggacacgaaaacaggtggtgcatggctgtcgtcagctcgtgtcgtgagatgttgggtcaagtcccgcaacgagcgcaacccctgtccctcgttgccagcgcgcaaaggcggggactcaagggagactgccgcggacaacgcggaggaaggcggggacgacgtcaagtcatcatgccccttatgccctgggctacacacgtactacaatgggatggacagagggcagcgagcccgcgagggcgagcgaaccccggaaagcatcccccagttcggattgcaggctgaaacccgcctgcatgaagttggaatcgctagtaatcgcaggtcagcatactgcggtgaatacgttcccgggccttgtacacaccgcccgtcacaccacggaagtcattcacacccgaagccggcgacgcaaccgcaaggagccagccgcccaaggtgggggcgatgactggggtgaagtcgtaacaaggtagccgtatcggaaggtgcggctggatcacctcctttctaa

SEQ ID NO: 5805 - DNA, 1551 bp, Mixta calida
  ref <308>: DATABASE ACCESSION NUMBER: NCBI ACCESSION: NZ_CP026378.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcctaacacatgcaagtcgaacggtaacaggaagcagcttgctgcttcgctgacgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggatggtgcttaatacgcgccgtcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtttccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaagct

SEQ ID NO: 5806 - DNA, 1544 bp, Mixta gaviniae
  ref <308>: DATABASE ACCESSION NUMBER: NCBI ACCESSION: NZ_CP026377.1
  ref <309>: DATABASE ENTRY DATE: 2019-04-01
  ref <313>: RELEVANT RESIDUES IN SEQ ID NO: (1)..(1544)
aaattgaagagtttgatcatggctcagattgaacgctggcggcaggcctaacacatgcaagtcgaacggtaacaggaagcagcttgctgcttcgctgacgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggatggcgtttaatacgcgccgtcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 5807 - DNA, 1546 bp, Mixta theicola
  ref <308>: DATABASE ACCESSION NUMBER: NCBI ACCESSION: NZ_NWUO01000040.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcgaacggtaacaggaagcagcttgctgcttcgctgacgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggaataaggttaataaccttgttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtgagcttgactcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattctgcagagatgcggaagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 5808 - DNA, 1535 bp, Mobilisporobacter senegalensis
  ref <308>: DATABASE ACCESSION NUMBER: NCBI ACCESSION: NZ_RJVG01000025.1
  ref <309>: DATABASE ENTRY DATE: 2019-04-01
  ref <313>: RELEVANT RESIDUES IN SEQ ID NO: (1)..(1535)
attgacttagtggcggacgggtgagtaacgcgtgggtaacctgcctcatacagggggataacagttggaaacgactgctaagaccgcataagcctacagtttcgcatgagacagtaggaaaatatttataggtatgagatggacccgcgtctgattagctagttggtgaggtaacggcccaccaaggcgacgatcagtagccgacttgagagagtgatcggccacattgggactgagacacggcccaaactcctacgggaggcagcagtggggaatattgcacaatgggggaaaccctgatgcagcgacgccgcgtgagtgaagaagtatttcggtatgtaaagctctatcagcaaggaagataatgacggtacttgactaagaagccccggctaactacgtgccagcagccgcggtaatacgtagggggcaagcgttatccggatttactgggtgtaaagggagcgtaggtggtatggtaagtcagatgtgaaagcccagggctcaaccctgggactgcatttgaaactgccaaactagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcgggggtcataagaccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggtcttgacatccctctgaccggtccttaaccgggccttcccttcggggcagaggagacaggtggtgcatggttgtcgtcagctcgtgtcgtgagatgttgggttaagtcccgcaacgagcgcaacccttatctttagtagccagcattttggatgggcactctagagagactgccagggataacctggaggaaggtggggatgacgtcaaatcatcatgccccttatgatctgggctacacacgtgctacaatggtgataacaaagagaagcgaagtcgtgaggcgaagcaaatctcaaaaatgtcatctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtctgtgacccaacccttatcagtgaatatgacgtcgtgataattgaatgaacgaagtgagttcaattatattcgaaaaaagaatacgtcacgaagtcagtcatgttcagtgataagggagggagcagccgaaggcaggttcgataactggggtgaagtcgtaacaaggtagccgtatcggaaggtgcggctggatcacctcctttctaaggaa

SEQ ID NO: 5809 - DNA, 1471 bp, Monaibacterium marinum
  ref <308>: DATABASE ACCESSION NUMBER: NCBI ACCESSION: NZ_OCTN01000020.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagatcttcggatctagcggcggacgggttagtaacgcgtgggaacgtgcctctctctacggaatagtcccgggaaactgggtttaataccgtatacgcccttcgggggaaagatttatcggagagagatcggcccgcgtaagattagatagttggtggggtaacggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgaagaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcacgtaggcggaccaaaaagttgggggtgaaatcccggggctcaaccccggaactgcctccaaaactgttggtctagaggtcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagggagcttgctctttggtgacgcagttaacgctttaagcattccgcctggggagtacggtcgcaagattaaaactcaaaggaattgacgggggcccgcacaagcggtggagcatgtggtttaattcgaagcaacgcgcagaaccttaccatcctttgacatacctatcgcagaaccagagatggttccttcagttcggctggataggatacaggtgctgcatggctgtcgtcagctcgtgtcgtgagatgttgggttaagtcccgcaacgagcgcaaccctcgccattagttgccagcatttagttgggcactctagtggaaccgccggtgataagccggaggaaggtggggatgacgtcaagtcctcatggcccttacaggatgggctacacacgtgctacaatggcagtgacaatgggttaatccccaaaagctgtctcagttcggattggggtctgcaactcgaccccatgaagttggaatcgctagtaatcgcgtaacagcatgacgcggtgaatacgttcccgggccttgtacacaccgcccgtcacaccatgggagttgggtttacccgaaggtggtgcgccaacctgttcgcaggaggcagccaaccacggtaagctcagcgactggggtgaagtcgtaacaaggtagccgtaggggaacctgcggctggatcacctcctttctaa

SEQ ID NO: 5810 - DNA, 1525 bp, Mongoliibacter ruber
  ref <308>: DATABASE ACCESSION NUMBER: NCBI ACCESSION: NZ_PVTR01000030.1
  ref <309>: DATABASE ENTRY DATE: 2019-04-01
  ref <313>: RELEVANT RESIDUES IN SEQ ID NO: (1)..(1525)
tacaacggagagtttgatcctggctcaggatgaacgctagcggcaggcctaatacatgcaagtcgtacggtagagatactttcgggtattttgagagtggcgcacgggtgcgtaacgcgtatgcaacctaccttttacagggggatagcccggggaaacccggattaataccccatggtattattgatctgcatgggttgataattaaagatttatcggtaagagatgggcatgcgtaggattagctagttggtagggtaacggcctaccaaggcgacgatccttaggggttctgagaggaaggtcccccacactggcactgagatacgggccagactcctacgggaggcagcagtagggaatattgggcaatggtcggaagactgacccagccatgccgcgtgcaggaagacggccttacgggttgtaaactgcttttatcagggaagaaaaaggccatgcgtggcaaattgccggtacctgatgaataagcaccggctaactccgtgccagcagccgcggtaatacggagggtgcaagcgttgtccggatttattgggtttaaagggtgcgtaggcggctttataagtcagcggtgaaagtttcaggctcaacctggaaattgccattgatactgtatagcttgagtgcgttctgggtacatggaatttatggtgtagcggtgaaatgcatagataccataaggaacaccgatagcgtaggcattgtactgggacgtaactgacgctgatgcacgaaagcatgggtagcgaacaggattagataccctggtagtccatgccgtaaacgatgatcactcgctgtcatgcctctatggtgtggtggccaagcgaaagcgttaagtgatccacctggggagtacgccggcaacggtgaaactcaaaggaattgacgggggtccgcacaagcggtggagcatgtggtttaattcgatgatacgcgaggaaccttacccgggctagaatgtgaaggaatgatttagagatagatcagtcggcaacgacctgaaacaaggtgctgcatggctgtcgtcagctcgtgccgtgaggtgttgggttaagtcccgcaacgagcgcaacccctgtgtccagttgccatcgggtgaagccggggactctggacagactgcctgcgcaagcagagaggaaggaggggacgacgtcaagtcatcatggcccttacgcccggggcgacacacgtgctacaatggcgcatacagcgggtagctacctggcaacaggatgccaacctctaaaagtgcgtctcagttcggatcggggtctgcaacccgaccccgtgaagctggaatcgctagtaatcgcgcatcagccatggcgcggtgaatacgttcccggaccttgtacacaccgcccgtcaagccatggaagtcgggtagacctgaaggcggtaaccgcaaggagccgttaagggtagaaccggtaactggggctaagtcgtaacaaggtagccgtaccggaaggtgcggctggaacacctcctttct

SEQ ID NO: 5811 - DNA, 1534 bp, Monoglobus pectinilyticus
  ref <308>: DATABASE ACCESSION NUMBER: NCBI ACCESSION: NZ_CP020991.1
  ref <309>: DATABASE ENTRY DATE: 2019-04-01
  ref <313>: RELEVANT RESIDUES IN SEQ ID NO: (1)..(1534)
ttaatcgagagtttgatcctggctcaggacgaacgctggcggcgtgcctaacacatgcaagtcgagcgagaaatttttaacggatcccttcggggagaagataaggatggaaagcggcggacgggtgagtaacgcgtgagtaacctgcctttaggagggggacaacattccgaaagggatgctaataccgcataaaattattgtatcgcatggtataataatcaaagatttatcgcctaaagatggactcgcgtccgattagctagttggtggggtaaaagcctaccaaggcgacgatcggtagccgaactgagaggttgatcggccacattgggactgagacacggcccagactcctacgggaggcagcagtgggggatattgcgcaatgggggaaaccctgacgcagcaacgccgcgtgaaggaagaaggccttcgggttgtaaacttctttaagtgtggaagataatgacggtacacacagaataagccacggctaactacgtgccagcagccgcggtaatacgtaggtggcaagcgttgtccggatttactgggtgtaaagggcgtgtaggcgggtagacaagtcagatgtgaaataccggggctcaactccggggctgcatttgaaactgtatatcttgagtgtcggagaggaaagcggaattcctagtgtagcggtgaaatgcgtagatattaggaggaacaccagtggcgaaggcggctttctggacgataactgacgctgaggcgcgaaagcgtggggagcaaacaggattagataccctggtagtccacgccgtaaacgatggatactaggtgtaggaggtatcgaccccttctgtgccgcagttaacacaataagtatcccacctggggagtacggtcgcaagattgaaactcaaaggaattgacgggggcccgcacaagcagtggagtatgtggtttaattcgaagcaacgcgaagaaccttaccaggacttgacatcccacgcatagcctagagataggtgaagtcctacgggacgtggagacaggtggtgcatggttgtcgtcagctcgtgtcgtgagatgttgggttaagtcccgcaacgagcgcaacccttactgtcagttaccatcattaagttggggactctggcaggactgccggtgacaaatcggaggaaggtggggacgacgtcaaatcatcatgccccttatgtcctgggctacacacgtactacaatggctgttaacaaagtgaagcaaagcagtgatgtggagcaaaacacaaaaagcagtctcagttcagattgtaggctgaaactcgcctatatgaagtcggaattgctagtaatcgcagatcagcatgctgcggtgaatacgttcccgggccttgtacacaccgcccgtcacaccatgagagtcgataacacccgaagcctgtagcttaaccttagggagagcgcagtcgaaggtgggattgataattagggtgaagtcgtaacaaggtagccgtatcggaaggtgcggctggatcacctcctttcta

SEQ ID NO: 5812 - DNA, 1490 bp, Moorea bouillonii
  ref <308>: DATABASE ACCESSION NUMBER: NCBI ACCESSION: NZ_MKZS01000001.1
  ref <309>: DATABASE ENTRY DATE: 2019-04-01
  ref <313>: RELEVANT RESIDUES IN SEQ ID NO: (1)..(1490)
catggagagtttgatcctggctcaggatgaacgctggcggtatgcttaacacatgcaagtcgaacgccccttcgggggagtggcggacgggtgagtaacgcgtgagaatctgccttagggtcggggacaaccaccggaaacagtggctaataccggatgtgccgagaggtgaaagatttattgccataagaggagctcgcgtctgattagctagttggtagggtaaaggcttaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttatcagggaagaagaaagtgacggtacctgaggaaaaagcatcggctaactccgtgccagcagccgcggtaatacggaggatgcaagcgttatccggaattattgggcgtaaagcgtccgtaggtggtacctcaagtcggctgttaaagaccagggcttaactctgggcaggcagtggaaactgaggaactagagggcagtaggggtagagggaattcccggtgtagcggtgaaatgcgtagatttcgggaagaacatcggtggcgaaggcgctctactggactgaacctgacactgagggacgaaagctaggggagcgaatgggattagataccccagtagtcctagctgtaaacgatggatactaggtgtagcttgtatcgacccaagctgtgccgaagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccggtgaaagctgggagtgccttcgggagcgcgaacacaggtggtgcatggctgtcgtcagctcgtgtcgtgagatgttgggttaagtcccgcaacgagcgcaaccctcgtttttagttgccagcacgtggtggtgggcactctagagagactgccggtgacaaaccggaggaaggtggggatgacgtcaagtcagcatgccccttacgccctgggctacacacgtactacaatggtcaggacaatgggcagccaactcgcaagggggagctaatctcatcaaacctggcctcagttcagattgccggctgcaactcgccggcatgaaggaggaatcgctagtaatcgccggtcagaatacggcggtgaatccgttcccgggccttgtacacaccgcccgtcacaccatggaagctggccacgcccgaagtcgttaccctaacccgtatgggagggggatgccgaaggcagggttggtgactggggtgaagtcgtaacaaggtagccgtaccggaaggtgtggctggatcacctccttttc

SEQ ID NO: 5813 - DNA, 1487 bp, Moorea producens
  ref <308>: DATABASE ACCESSION NUMBER: NCBI ACCESSION: NZ_MKZR01000001.1
  ref <309>: DATABASE ENTRY DATE: 2019-04-01
  ref <313>: RELEVANT RESIDUES IN SEQ ID NO: (1)..(1487)
catggagagtttgatcctggctcaggatgaacgctggcggtatgcttaacacatgcaagtcgaacgccccttcgggggagtggcggacgggtgagtaacgcgtgagaatctgccttcgggtcggggacaaccaccggaaacagtggctaataccggatatgcctattggtgaaagatttattgccagaagaggagctcgcgtctgattagctagttggtagggtaaaggcctaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttatcagggaagaagaaagtgacggtacctgaggaaaaagcatcggctaactccgtgccagcagccgcggtaatacggaggatgcaagcgttatccggaattattgggcgtaaagggtccgtaggtggtacctcaagtcggctgttaaagaccagggcttaactctgggcaggcagtggaaactgaggaactagagggcagtaggggtagagggaattcccggtgtagcggtgaaatgcgtagatttcgggaagaacatcggtggcgaaggcgctctactggactgcacctgacactgagggacgaaagctaggggagcgaatgggattagataccccagtagtcctagctgtaaacgatggatactaggtgtagcttgtatcgacccaagctgtgccgaagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccggtgaaagctgggagtgccttagggagcgcgaacacaggtggtgcatggctgtcgtcagctcgtgtcgtgagatgttgggttaagtcccgcaacgagcgcaaccctcgtttttagttgccagcacttcaggtgggcactctagagagactgccggtgacaaaccggaggaaggtggggatgacgtcaagtcagcatgccccttacgtcctgggctacacacgtactacaatggtgaggacaatgggcagccaacccgcaagggggagctaatctcatcaaacctggcctcagttcagattgccggctgcaactcgccggcatgaaggaggaatcgctagtaatcgccggtcagaatacggcggtgaatccgttcccgggccttgtacacaccgcccgtcacaccatggaagctggccacgcccgaagtcgttaccctaaccctttagggagggggatgccgaaggcagggttggtgactggggtgaagtcgtaacaaggtagccgtaccggaaggtgtggctggatcacctccttt

SEQ ID NO: 5814 - DNA, 1570 bp, Moorella glycerini; identical to SEQ ID NO: 667
  ref <308>: DATABASE ACCESSION NUMBER: NCBI ACCESSION: NZ_CELZ01000013.1
  ref <309>: DATABASE ENTRY DATE: 2019-04-01
  ref <313>: RELEVANT RESIDUES IN SEQ ID NO: (1)..(1570)

SEQ ID NO: 5815 - DNA, 1664 bp, Moorella mulderi
  ref <308>: DATABASE ACCESSION NUMBER: NCBI ACCESSION: NZ_LTBC01000042.1
  ref <309>: DATABASE ENTRY DATE: 2019-04-01
  ref <313>: RELEVANT RESIDUES IN SEQ ID NO: (1)..(1664)
tttacggagagtttgatcctggctcaggacaaacgctggcggcgtgcctaacacatgcaagtcgagcggtctttactttgcggaatcttcggaggaagcgaggtaaagatagcggcggacgggtgagtaacgcgtgggtaatctacccttcagaccgggataacaccgggaaactggtgctaataccggatacgttctaccggaggcatctcgggtagaagaaaggaagcaagcgaccgctgaaggatgagcccgcgtcccattagctagttggtgaggtaacggctcaccaaggcgacgatgggtagccggcctgagagggtggtcggccacactgggactgagacacggcccagactcctacgggaggcagcagtggggaatcttgcgcaatgggcgaaagcctgacgcagcgacgccgcgtgagcgatgaaggccttcgggttgtaaagctctgtcatcagggacgaagtctcgtgcaaacgaggtgacggtacctgaggaggaagccccggctaactacgtgccagcagccgcggtaaaacgtagggggcgagcgttgtccggaattactgggcgtaaagggcgtgtaggcggcccggcaagtcagatgtgaaaaacccaggctcaacctggggggtgcatttgaaactggcgggcttgagggcaggagaggagagtggaattcccggtgtagcggtgaaatgcgtagatatcgggaggaacaccagtggcgaaggcgactctctggactgaccctgacgctgaggcgcgaaagcgtggggagcaaacaggattagataccctggtagtccacgccgtaaacgatgggtactaggtgttggaggtatcgacccctccagtgccgcagttaacacaataagtaccccgcctggggagtacggccgcaaggctgaaactcaaaggaattgacgggggcccgcacaagcggtggagcatgtggtttaattcgacgcaacgcgaagaaccttaccggggtttgacatcccgcgaacctggtggaaacaccggggtgccggtttttaccggagcgcggagacaggtggtgcatggttgtcgtcagctcgtgtcgtgagatgttgggttaagtcccgcaacgagcgcaacccctacctttagttgccagcacgtaaaggtgggcactctaaagggactgccggtgacaaaccggaggaaggtggggatgacgtcaaatcatcatgccccttatatcccgggctacacacgtgctacaatggcctgtacaaaggggggcgaacccgcgagggggagcaaatcccaaaaagcaggtctcagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgacccaacccagcactcaactgaaagagtcagaggagggtttaaggagcaggaggagttccgagcaggaacgaaagcaaacccgaagatgactctttgagttgagtgctgggagggagccgtcgaaggtggggctggtgattggggtgaagtcgtaacaaggtagccgtatcggaaggtgcggctggatcacctcctttctaaggag

SEQ ID NO: 5816 - DNA, 1578 bp, Moorella thermoacetica
  ref <308>: DATABASE ACCESSION NUMBER: NCBI ACCESSION: NZ_MDDC01000044.1
  ref <309>: DATABASE ENTRY DATE: 2019-04-01
  ref <313>: RELEVANT RESIDUES IN SEQ ID NO: (1)..(1578)
attttacggagagtttgatcctggctcaggacaaacgctggcggcgtgcctaacacatgcaagtcgagcggtctttaatctgtgaagtcttcgggcggaacggattaaagatagcggcggacgggtgagtaacgcgtgggcaatctacccttcagaccgggataacaccgggaaactggtgctaataccggatacggtctacgggaggcatctcctgtagaagaaaggtggcgaaagctaccgctgaaggatgagcccgcgtcccattagctagttggtgaggtaacggctcaccaaggcgacgatgggtagccggcctgagagggtggccggccacactgggactgagacacggcccagactcctacgggaggcagcagtggggaatcttgcgcaatgggcgaaagcctgacgcagcaacgccgcgtgagcgatgaaggccttcgggttgtaaagctctgtcatcagggacgaagtcttaaaggcgaatagtctttaaggtgacggtacctgaggaggaagccccggctaactacgtgccagcagccgcggtaaaacgtagggggcgagcgttgtccggaattactgggcgtaaagggcgtgtaggcggcccggcaagtcagatgtgaaaaaccccggcttaaccgggggcatgcatttgaaactgccgggcttgagggcaggagaggagagtggaattcccggtgtagcggtgaaatgcgtagatatcgggaggaacaccagtggcgaaggcgactctctggcctggccctgacgctgaggcgcgaaagcgtggggagcaaacaggattagataccctggtagtccacgccgtaaacgatgggtactaggtgtaggaggtatcgaccccttctgtgccgcagtaaacacaataagtaccccgcctggggagtacggccgcaaggctgaaactcaaaggaattgacgggggcccgcacaagcggtggagcatgtggtttaattcgacgcaacgcgaagaaccttaccggggtttgacatcctgcgaacctggtggaaacaccggggtgcccttcggggaacgcagagacaggtggtgcatggttgtcgtcagctcgtgtcgtgagatgttgggttaagtcccgcaacgagcgcaacccctacctttagttgccagcgggtaaagccgggcactctaaagggactgccggtgacaaaccggaggaaggtggggatgacgtcaaatcatcatgccccttatatcccgggctacacacgtgctacaatggcctgtacaaaggggtgcgaaggagcgatccggagcgaatcccaaaaagcaggtctcagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgacctaacccgcaagggaaggagccgtctaaggtggggctggtgattggggtgaagtcgtaacaaggtagccgtatcggaaggtgcggctggatcacctcctttctaaggag

SEQ ID NO: 5817 - DNA, 1537 bp, Moraxella cuniculi
  ref <308>: DATABASE ACCESSION NUMBER: NCBI ACCESSION: NZ_LR134343.1
  ref <309>: DATABASE ENTRY DATE: 2019-04-01
  ref <313>: RELEVANT RESIDUES IN SEQ ID NO: (1)..(1537)
aagattaaactgaagagtttgatcatggctcagattgaacgctggcggcaggcttaacacatgcaagtcgaacgaagttagggagcttgctcctgatacttagtggcggacgggtgagtaatgcttaggaatctgcctagtagtgggggataactatccgaaaggatagctaataccgcatacgacctacgggtgaaagggggcgtaagctctcgctattagatgagcctaagtcggattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagctaatagctaatacctattagccctgacgttacccacagaataagcaccggctaactctgtgccagcagccgcggtaatacagagggtgcaagcgttaatcggaattactgggcgtaaagcgcgcgtaggtggttacttaagtcagatgtgaaagccccgggcttaacctgggaactgcatctgatactgggtaactagagtaggtgagagggaagtagaattccaggtgtagcggtgaaatgcgtagagatctggaggaataccgatggcgaaggcagcttcctggcatcatactgacactgaggtgcgaaagcgtgggtagcaaacaggattagataccctggtagtccacgccgtaaacgatgtctaccagtcgttgggtctcttgaagacttagtgacgcagttaacgcaataagtagaccgcctggggagtacggccgcaaggttaaaactcaaatgaattgacgggggcccgcacaagcggtggagcatgtggtttaattcgatgcaacgcgaagaaccttacctggtcttgacatacacagaattcgctagagatagcttagtgccttcgggaactgtgatacaggtgctgcatggctgtcgtcagctcgtgtcgtgagatgttgggttaagtcccgcaacgagcgcaacccttttccttagttaccagcgatttaagtcgggaactctaaggatactgccagtgacaaactggaggaaggcggggacgacgtcaagtcatcatggcccttacgaccagggctacacacgtgctacaatggttggtacaaagggttgctacacagcgatgtgatgctaatctcaaaaagccaatcgtagtccggattggagtctgcaactcgactccatgaagtcggaatcgctagtaatcgcagatcagaatgctgcggtgaatacgttcccgggccttgtacacaccgcccgtcacaccatgggagttgatctcaccagaagtggttagcctaacgcaagagggcgatcaccacggtggggtcgatgactggggtgaagtcgtaacaaggtagccgtaggggaacctgcggctggatcacctccttaa

SEQ ID NO: 5818 - DNA, 1547 bp, Moraxella osloensis
  ref <308>: DATABASE ACCESSION NUMBER: NCBI ACCESSION: NZ_UGPY01000001.1
  ref <309>: DATABASE ENTRY DATE: 2019-04-01
  ref <313>: RELEVANT RESIDUES IN SEQ ID NO: (1)..(1547)
tagatagaaagattaaactgaagagtttgatcatggctcagattgaacgctggcggcaggcttaacacatgcaagtcgaacgatgactctctagcttgctagagatgattagtggcggacgggtgagtaacatttaggaatctacctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctctcagagatgagagagtgccttcgggaactcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagtctattgcaccagaagtaggtagcctaacgaaagagggcgcttaccacggtgtggtcgatgactggggtgaagtcgtaacaaggtagccgtaggggaacctgcggctggatcacctccttaa

SEQ ID NO: 5819 - DNA, 1525 bp, Motilibacter peucedani
  ref <308>: DATABASE ACCESSION NUMBER: NCBI ACCESSION: NZ_RBWV01000010.1
  ref <309>: DATABASE ENTRY DATE: 2019-04-01
  ref <313>: RELEVANT RESIDUES IN SEQ ID NO: (1)..(1525)
ttgttggagagtttgatcctggctcaggacgaacgctggcggcgtgcttaacacatgcaagtcgagcggtgaacctgcttcggtgggggatcagcggcgaacgggtgagtaacacgtgagcaacctgcctctagcttcgggataactccgggaaaccggggctaataccggatatgacttctcgccgcatggtggggggtggaaagatttatcggctggagatgggctcgcggcctatcagcttgttggtggggttgtggcctaccaaggcgacgacgggtagccggcctgagagggtgaccggccacactgggactgagacacggcccagactcctacgggaggcagcagtggggaatcttgcgcaatgggcggaagcctgacgcagcgacgccgcgtgggggatgaaggccttcgggttgtaaacctctttcagcgccgaagaagcgaaagtgacggtaggcgcagaagaagcaccggctaactacgtgccagcagccgcggtaatacgtagggtgcaagcgttgtccggaattattgggcgtaaagagctcgtaggtggcgggtcacgtcgggtgtgaaagcccggggcttaaccccgggtctgcattcgatacgggcttgctagggtccggcaggggagactggaattcctggtgtagcggtgaaatgcgcagatatcaggaggaacaccggtggcgaaggcgggtctctgggccggtaccgacgctgaggagcgaaagcgtggggagcgaacaggattagataccctggtagtccacgccgtaaacgttgggcgctaggtgtggggagcattccacgttctctgtgccgtagctaacgcattaagcgccccgcctggggagtacggccgcaaggctaaaactcaaaggaattgacgggggcccgcacaagcggcggagcatgtggcttaattcgacgcaacgcgaagaaccttaccaaggcttgacatccacggaaaagccgcagagatgtggtgtccttcggggtcgtggacaggtggtgcatggctgtcgtcagctcgtgtcgtgagatgttgggttaagtcccgcaacgagcgcaaccctcgtcccatgttgccagcattcagttggggactcatgggagactgccggggtcaactcggaggaaggtggggatgacgtcaagtcatcatgccccttatgtcttgggctgcacacatgctacaatggccggtacaaagggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagccggtggcctaacccgcaagggagggagctgtcgaaggtgggactggcgattgggacgaagtcgtaacaaggtagccgtaccggaaggtgcggctggatcacctcctttctaaggag

SEQ ID NO: 5820 - DNA, 1544 bp, Motiliproteus coralliicola
  ref <308>: DATABASE ACCESSION NUMBER: NCBI ACCESSION: NZ_QQOH01000010.1
  ref <309>: DATABASE ENTRY DATE: 2019-04-01
  ref <313>: RELEVANT RESIDUES IN SEQ ID NO: (1)..(1544)
gaactgaagagtttgatcatggctcagattgaacgctggcggcaggcttaacacatgcaagtcgagcggtaacaggactagcttgctagttgctgacgagcggcggacgggtgagtaacgcgtaggaatctacctagtagtgggggatagcccagagaaatttggattaataccgcatacgccctacgggggaaaggaggggatcttcggacctttcgctattagatgagcctgcgtgagattagctagttggtggggtaaaggctcaccaaggcgacgatctctagctggtctgagaggatgatcagccacactgggactgagacacggcccagactcctacgggaggcagcagtggggaatattgcacaatgggcgcaagcctgatgcagccatgccgcgtgtgtgaagaaggccttcgggttgtaaagcactttcagcgaggaggaaaggttggcagttaatacctgtcagctgtgacgttactcgcagaagaagcaccggctaactccgtgccagcagccgcggtaatacggagggtgcgagcgttaatcggaattactgggcgtaaagcgcgcgtaggcggctaagtcagtcagatgtgaaagccccgggctcaacctgggaactgcacctgatactgcttagctagagtttggtagaggggtgtggaatttcctgtgtagcggtggaatgcgtagatataggaaggaacaccagtggcgaaggcgacaccctggaccaaaactgacgctgaggtgcgaaagcgtggggagcaaacaggattagataccctggtagtccacgccgtaaacgatgtctactagccgttggggaacttgatttcttagtggcgcagctaacgcgataagtagaccgcctggggagtacggccgcaaggttaaaactcaaatgaattgacgggggcccgcacaagcggtggagcatgtggtttaattcgaagcaacgcgaagaaccttacccgctcttgacatcctgcgaactttctagagatagattggtgccttcgggaacgcagagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgagcggggctacacacgtgctacaatgggcaggacaaacggtcgcgaagcggcgacgtggagctaatccgagaaacctgttcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtagctagcttaaccttcgggagggcggttaccacggtgtggttcatgactggggtgaagtcgtaacaaggtagccctaggggaacctggggctggatcacctccttaaac

SEQ ID NO: 5821 - DNA, 1525 bp, Mucilaginibacter auburnensis
  ref <308>: DATABASE ACCESSION NUMBER: NCBI ACCESSION: NZ_PGFJ01000001.1
  ref <309>: DATABASE ENTRY DATE: 2019-04-01
  ref <313>: RELEVANT RESIDUES IN SEQ ID NO: (1)..(1525)
acaatggagagtttgatcctggctcaggatgaacgctagcggcaggcctaatacatgcaagtcggacgggataggagagcttgctttccttgagagtggcgcacgggtgcgtaacacgtatgtaacctaccttaatctgggggatagcctctcgaaagagagattaacaccgcataacattattgaatagcattatttaataatcaaatatttataggattaagatgggcatgcggaacattagctagttggtgtggtaacggcataccaaggctacgatgtttaggggatctgagaggatgaccccccacactggtactgagacacggaccagactcctacgggaggcagcagtaaggaatattggtcaatggacgcaagtctgaaccagccatgccgcgtgcaggaagacggccctacgggttgtaaactgcttttgcaggggaataaaccttcgtatgtatacgaagctgaatgtactctgagaataaggatcggctaactccgtgccagcagccgcggtaatacggaggatccaagcgttatccggatttattgggtttaaagggtgcgtaggtggtttattaagtcaggggtgaaagacggcagcttaactgtcgcagtgcctttgatactgatgaacttgaatgaactagaggtaggcggaatgtgacaagtagcggtgaaatgcatagatatgtcacagaacaccaattgcgaaggcagcttactatggtttaattgacactgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgcctatgcaaatagagaggaaggaggggacgacgtcaagtcatcatggcccttacgtccggggctacacacgtgctacaatggtcagtacagagggcagctacctggcaacaggatgccaatctcacaaagctgatcacagttcggatcggggtctgcaactcgaccccgtgaagttggattcgctagtaatcgcgtatcagcaatgacgcggtgaatacgttcccgggccttgtacacaccgcccgtcaagccatggaagctggaagtacctgaagtcggtaaccgcaaggagccgcctagggtaaagtcggtaactggggctaagtcgtaacaaggtagccgtaccggaaggtgtggctggaatacctcctttctg

SEQ ID NO: 5822 - DNA, 1529 bp, Mucilaginibacter gossypii
  ref <308>: DATABASE ACCESSION NUMBER: NCBI ACCESSION: NZ_FNCG01000040.1
  ref <309>: DATABASE ENTRY DATE: 2019-04-01
  ref <313>: RELEVANT RESIDUES IN SEQ ID NO: (1)..(1529)
tacaatggagagtttgatcctggctcaggatgaacgctagcggcaggcctaatacatgcaagtcggacgggataggagagcttgctttccttgagagtggcgcacgggtgcgtaacacgtatgtaacctaccttgatcagggggatagcctctcgaaagagagattaagaccgcataacattatgatatggcatcgtattataatcaaatatttataggatcaagatgggcatgcgcaacattagctagttggtgtggtaacggcataccaaggcgacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgcaggggaataaacctcgatacgtgtatcgagttgaatgtaccttgagaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgtgacagagacgtcacagttcttcggaacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatggtacagagggcagctacctggcaacaggatgccaatctcttaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctggagc

SEQ ID NO: 5823 - DNA, 1522 bp, Mucilaginibacter gracilis
  ref <308>: DATABASE ACCESSION NUMBER: NCBI ACCESSION: NZ_RBKU01000001.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcggcaggcctaatacatgcaagtcggacgggatttgggagcttgctcctgatgagagtggcgcacgggtgcgtaacacgtatgtaacctaccttatccagggggatagcctctcgaaagagagattaagaccgcataacattacgactcagcattgagatgtaatcaaatatttatagggataagatgggcatgcgggacattagctagttggcggggtaacggcccaccaaggcgacgatgtctaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgcaggggaataaaccttcgtatgtatacgaagctgaatgtactctgagaataaggatcggctaactccgtgccagcagccgcggtaatacggaggatccaagcgttatccggatttattgggtttaaagggtgcgtaggcggccaattaagtcaggggtgaaagacggtagcttaactatcgcagtgcctttgatactgattggcttgaatggactagaggtaggcggaatgtgacaagtagcggtgaaatgcatagatatgtcacagaacaccaattgcgaaggcagcttactatggtttaattgacgctgaggcacgaaagcgtggggatcaaacaggattagataccctggtagtccacgccctaaacgatgaacactcgatgttagcgatatacagttagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgattcagagacggatcagctcttcggagcacgaaactaggtgctgcatggctgtcgtcagctcgtgccgtgaggtgttgggttaagtcccgcaacgagcgcaacccctatgtttagttgccagcacgttaaggtggggactctaaacagactgcctacgcaagtagagaggaaggaggggacgacgtcaagtcatcatggcccttacgtccggggctacacacgtgctacaatggatggtacagagggcagctacctggcaacaggatgcaaatctcttaaagccattcacagttcggatcggggtctgcaactcgaccccgtgaagttggattcgctagtaatcgcatatcagcaatgatgcggtgaatacgttcccgggccttgtacacaccgcccgtcaagccatggaagctggaagtacctgaagtgcgtaaccgcaaggagcgtcctagggtaaagtcggtaactggggctaagtcgtaacaaggtagccgtaccggaaggtgcggctggaatacctccttt

SEQ ID NO: 5824 - DNA, 1523 bp, Mucilaginibacter kameinonensis
  ref <308>: DATABASE ACCESSION NUMBER: NCBI ACCESSION: NZ_RCWZ01000011.1
  ref <309>: DATABASE ENTRY DATE: 2019-04-01
  ref <313>: RELEVANT RESIDUES IN SEQ ID NO: (1)..(1523)
acaatggagagtttgatcctggctcaggatgaacgctagcggcaggcctaatacatgcaagtcggacgggatttgggagcttgctcccgatgagagtggcgcacgggtgcgtaacacgtatgtaacctaccttagtcagggggatagcctctcgaaagagagattaagaccgcataacatcattgaatggcatcgtttgatgatcaaatatttataggactaagatgggcatgcgcaacattagctagttggtgtggtaacggcataccaaggctacgatgtttaggggatctgagaggatgaccccccacactggtactgagacacggaccagactcctacgggaggcagcagtaaggaatattggtcaatggacggaagtctgaaccagccatgccgcgtgcaggaagacggccctatgggttgtaaactgcttttgcaggggaataaacctcggtacgtgtaccgagttgaatgtaccttgagaataaggatcggctaactccgtgccagcagccgcggtaatacggaggatccgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagtccttcgggacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatgatacagagggcagctacctggcaacaggatgccaatctcacaaagtcattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5825 - DNA, 1531 bp, Mucilaginibacter lappiensis
  ref <308>: DATABASE ACCESSION NUMBER: NCBI ACCESSION: NZ_FTMG01000033.1
  ref <309>: DATABASE ENTRY DATE: 2019-04-01
  ref <313>: RELEVANT RESIDUES IN SEQ ID NO: (1)..(1531)
tacaatggagagtttgatcctggctcaggatgaacgctagcggcaggcctaatacatgcaagtcggacgggattggagagcttgctttccatgagagtggcgcacgggtgcgtaacacgtatgtaacctaccttgatcagggggatagcctctcgaaagagagattaagaccgcataacattatggtgtggcatcacacatataatcaaatatttataggatcaagatgggcatgcggaacattagctagttggtaaggtaacggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctatgggttgtaaactgcttttataccggaataaaccttgattcgtgaatcaagctgaatgtacggtaagaataaggatcggctaactccgtgccagcagccgcggtaatacggaggatccaagcgttatccggatttattgggtttaaagggtgcgtaggtggttctttaagtcaggggtgaaagacggtagcttaactatcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaataaagcagagacgctttagtccttcgggacacgaaactaggtgctgcatggctgtcgtcagctcgtgccgtgaggtgttgggttaagtcccgcaacgagcgcaacccctatgtttagttgccagcacgtcaaggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctcataaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctggagc

SEQ ID NO: 5826 - DNA, 1522 bp, Mucilaginibacter oryzae
  ref <308>: DATABASE ACCESSION NUMBER: NCBI ACCESSION: NZ_QGHA01000030.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcggcaggcctaatacatgcaagtcggacgggattgggacttcggttccatgagagtggcgcacgggtgcgtaacacgtatgtaacctaccttagtcagggggatagcctctcgaaagagagattaagaccgcataaaatcatgatatggcatcgtattatgatcaaatatttataggactaagatgggcatgcgcaacattagctagttggtgtggtaacggcataccaaggcgacgatgtttaggggatctgagaggatgaccccccacactggtactgagacacggaccagactcctacgggaggcagcagtaaggaatattggtcaatggacggaagtctgaaccagccatgccgcgtgcaggaagacggccctatgggttgtaaactgcttttgcaggggaataaaccttcgtatgtatacgaagctgaatgtactctgagaataaggatcggctaactccgtgccagcagccgcggtaatacggaggatccgagcgttatccggatttattgggtttaaagggtgcgtaggcggctttttaagtcaggggtgaaagacggtagcttaactatcgcagtgcccttgatactgaagagcttgaatgtagttgaggtaggcggaatgtgacaagtagcggtgaaatgcatagatatgtcacagaacaccaattgcgaaggcagcttactaagctatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgaagcagagacgcttcagtccttcgggacacgaaactaggtgctgcatggctgtcgtcagctcgtgccgtgaggtgttgggttaagtcccgcaacgagcgcaacccctatgtttagttgccagcatgtaaaggtggggactctaaacagactgcctatgcaaatagagaggaaggaggggacgacgtcaagtcatcatggcccttacgtccggggctacacacgtgctacaatggatggtacagagggccgctacctggcaacaggatgccaatctcggaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5827 - DNA, 1521 bp, Mucilaginibacter paludis
  ref <308>: DATABASE ACCESSION NUMBER: NCBI ACCESSION: NZ_CM001403.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcggacgggataggagagcttgctttccttgagagtggcgcacgggtgcgtaacacgtatgtaacctaccttatccagggggatagcctctcgaaagagagattaagaccgcataacattattgaacagcattgtttaataatcaaatatttatagggataagatgggcatgcgggacattagctagttggtgtgggtaacggcccaccaaggcgacgatgtctaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgcaggggaataaaccctggtatgtataccaggttgaatgtactctgagaataaggatcggctaactccgtgccagcagccgcggtaatacggaggatccaagcgttatccggatttattgggtttaaagggtgcgtaggcggctttttaagtcaggggtgaaagacggtagcttaactatcgcagtgcctttgatactgaagagcttgaatgaactagaggtaggcggaatgtgacaagtagcggtgaaatgcatagatatgtcacagaacaccaattgcgaaggcagcttactatagttcgattgacgctgaggcacgaaagcgtggggatcaaacaggattagataccctggtagtccacgccctaaacgatgaacactcgatgttagcgatatacagttagcgtctaagcgaaagcgttaagtgttccacctggggagtacgcccgcaagggtgaaactcaaaggaattgacgggggcccgcacaggcggaggagcatgtggtttaattcgatgatacgcgaggaaccttacccgggcttgaaagttagtgaacgattcagagacggatcagtccttcgggacacgaaactaggtgctgcatggctgtcgtcagctcgtgccgtgaggtgttgggttaagtcccgcaacgagcgcaacccctatgtttagttgccagcacgtcaaggtggggactctaaacagactgcctacgcaagtagagaggaaggaggggacgacgtcaagtcatcatggcccttacgtccggggctacacacgtgctacaatggtcagtacagagggctgctacctggcaacaggatgccaatctcttaaagctgatcacagttcggatcggggtctgcaactcgaccccgtgaagttggattcgctagtaatcgcgtatcagcaatgacgcggtgaatacgttcccgggccttgtacacaccgcccgtcaagccatggaagctggaagtacctgaagtgcgtaaccgcaaggagcgtcctagggtaaagtcggtaactggggctaagtcgtaacaaggtagccgtaccggaaggtgcggctggaatacctcctttct

SEQ ID NO: 5828 - DNA, 1529 bp, Mucilaginibacter pedocola
  ref <308>: DATABASE ACCESSION NUMBER: NCBI ACCESSION: NZ_MBTF01000012.1
  ref <309>: DATABASE ENTRY DATE: 2019-04-01
  ref <313>: RELEVANT RESIDUES IN SEQ ID NO: (1)..(1529)
ttatacaatggagagtttgatcctggctcaggatgaacgctagcggcaggcctaatacatgcaagtcggacgggatttgggagcttgctcctgatgagagtggcgcacgggtgcgtaacacgtatgtaacctaccttaaccagggggatagcctctcgaaagagagattaagaccgcataatattatcgaatagcattgtttgataatcaaatatttatagggttaagatgggcatgcggaacattagctagttggtaaggtaatggcttaccaaggctacgatgtttaggggatctgagaggatggccccccacactggtactgagacacggaccagactcctacgggaggcagcagtaaggaatattggtcaatgggcggaagcctgaaccagccatgccgcgtgcaggaagacggccctatgggttgtaaactgcttttgtaccggaataaacctttggtcgtgaccgaagctgaatgtacggtaagaataaggatcggctaactccgtgccagcagccgcggtaatacggaggatccgagcgttatccggatttattgggtttaaagggtgcgtaggcggcctattaagtcaggggtgaaagacggtagcttaactatcgcagtgcctttgatactgatgggcttgaatgtagttgaggtaggcggaatgtggcaagtagcggtgaaatgcatagatatgccacagaacaccaattgcgaaggcagcttactaagctaagattgacgctgaggcacgaaagcgtggggatcaaacaggattagataccctggtagtccacgccctaaacgatgaatactcgatgttggcgatatacggccagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagcgaatggagcagagacgctccagtccttcgggacgcgaaactaggtgctgcatggctgtcgtcagctcgtgccgtgaggtgttgggttaagtcccgcaacgagcgcaacccctatgtttagttgccagcatgtaatgatggggactctaaacagactgcctatgcaaatagagaggaaggaggggacgacgtcaagtcatcatggcccttacgtccggggctacacacgtgctacaatgggcagtacagagggcagctacctggcaacaggatgccaatctcataaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctgggggtgcctgaagccggtaaccgcaaggagccgtctagggtaaaaccggtaactggggctaagtcgtaacaaggtagccgtaccggaaggtgtggctggaatacctcctttctg

SEQ ID NO: 5829 - DNA, 1522 bp, Mucilaginibacter pineti
  ref <308>: DATABASE ACCESSION NUMBER: NCBI ACCESSION: NZ_FNAI01000037.1
  ref <309>: DATABASE ENTRY DATE: 2019-04-01
  ref <313>: RELEVANT RESIDUES IN SEQ ID NO: (1)..(1522)
atggagagtttgatcctggctcaggatgaacgctagcggcaggcctaatacatgcaagtcggacgggatagaagagcttgcttttcttgagagtggcgcacgggtgcgtaacacgtatgtaacctaccttgttcagggggatagcctctcgaaagagagattaagaccgcataacattattggatggcatcatttgataatcaaatatttataggaacaagatgggcatgcggaacattagctagttggtgaggtaactgctcaccaaggctacgatgtttaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgtaccggaataaacctttggtcgtgaccagagctgaatgtacggtaagaataaggatcggctaactccgtgccagcagccgcggtaatacggaggatccaagcgttatccggatttattgggtttaaagggtgcgtaggtggcctgttaagtcaggggtgaaagacggtagcttaactatcgcagtgcctttgatactgacgggcttgaatacactagaggtaggcggaatgtgacaagtagcggtgaaatgcatagatatgtcacagaacaccaattgcgaaggcagcttactatggtgtcattgacactgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaataaagcagagacgctttagtccttcgggacacgaaactaggtgctgcatggctgtcgtcagctcgtgccgtgaggtgttgggttaagtcccgcaacgagcgcaacccctatgtttagttgccagcacgtcaaggtggggactctaaacagactgcctatgcaaatagagaggaaggaggggacgacgtcaagtcatcatggcccttacgtccggggctacacacgtgctacaatggatggtacagagggccgctacctggcaacaggatgccaatctcttaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctg

SEQ ID NO: 5830 - DNA, 1523 bp, Mucilaginibacter rubeus
  ref <308>: DATABASE ACCESSION NUMBER: NCBI ACCESSION: NZ_QFKV01000037.1
  ref <309>: DATABASE ENTRY DATE: 2019-04-01
  ref <313>: RELEVANT RESIDUES IN SEQ ID NO: (1)..(1523)
acaatggagagtttgatcctggctcaggatgaacgctagcggcaggcctaatacatgcaagtcggacgggatttgggagcttgctcctaatgagagtggcgcacgggtgcgtaacacgtatgtaacctaccttgatcagggggatagcctctcgaaagagagattaagaccgcataacattatgatatggcatcgtattataatcaaatatttataggatcaagatgggcatgcgcaacattagctagttggtgtggtaacggcataccaaggcgacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgcaggggaataaaccccggttcgtgaaccgggttgaatgtaccttgagaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgtgacagagacgtcacagttcttcggaacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatggtacagagggcagctacctggcaacaggatgccaatctcttaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5831 - DNA, 938 bp, Mucilaginibacter sp. 17JY9-4
  ref <308>: DATABASE ACCESSION NUMBER: NCBI ACCESSION: NZ_SEWG01000011.1
  ref <309>: DATABASE ENTRY DATE: 2019-04-01
  ref <313>: RELEVANT RESIDUES IN SEQ ID NO: (1)..(938)
acaatggagagtttgatcctggctcaggatgaacgctagcggcaggcctaatacatgcaagtcggacgggattgtggagcttgcttcacatgagagtggcgcacgggtgcgtaacacgtatgtaacctaccttaatctgggggatagcctctcgaaagagagattaacaccgcataacattacgacatagcattttgttgtaatcaaatatttataggattaagatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaaccccttttcgtgaagagggctgaatgtacggtaagaataaggatcggctaactccgtgccagcagccgcggtaatacggaggatccaagcgttatccggatttattgggtttaaagggtgcgtaggcgacctattaagtcaggggtgaaagacggtagcttaactatcgcagtgcctttgatactgataggcttgaatacacttgaggtaggcggaatgtgacaagtagcggtgaaatgcatagatatgtcacagaacaccaattgcgaaggcagcttactaaagtgtcattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagca

SEQ ID NO: 5832 - DNA, 1518 bp, Mucilaginibacter sp. 94
  ref <308>: DATABASE ACCESSION NUMBER: NCBI ACCESSION: NZ_RBXF01000006.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgggatttgggagcttgctcctgatgagagtggcgcacgggtgcgtaacacgtatgtaacctaccttgatctgggggatagcctctcgaaagagagattaacaccgcataacattatcggatagcattttctgataatcaaatatttataggatcaagatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaaccctgatatgtatatcaggctgaatgtacggtaagaataaggatcggctaactccgtgccagcagccgcggtaatacggaggatccaagcgttatccggatttattgggtttaaagggtgcgtaggcggcctattaagtcaggggtgaaagacggtagcttaactatcgcagtgcctttgatactgataggcttgaatacacttgaggtaggcggaatgtgacaagtagcggtgaaatgcatagatatgtcacagaacaccaattgcgaaggcagcttactaaagtgagattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgagacagagacgtctcagtccttcgggacacgaaactaggtgctgcatggctgtcgtcagctcgtgccgtgaggtgttgggttaagtcccgcaacgagcgcaacccctatgtttagttgccagcacgttaaggtggggactctaaacagactgcctatgcaaatagagaggaaggaggggacgacgtcaagtcatcatggcccttacgtccggggctacacacgtgctacaatggatggtacagcgggcagctacctggcaacaggatgccaatctcgtaaagccattcacagttcggatcggggtctgcaactcgaccccgtgaagttggattcgctagtaatcgcatatcagcaatgatgcggtgaatacgttcccgggccttgtacacaccgcccgtcaagccatggaagttggaagtgcctgaagtgcgtaaccgcaaggagcgtcctagggtaaagtcgataactggggctaagtcgtaacaaggtagccgtaccggaaggtgtggctggaatacctccttt

SEQ ID NO: 5833 - DNA, 1531 bp, Mucilaginibacter sp. BJC16-A31
  ref <308>: DATABASE ACCESSION NUMBER: NCBI ACCESSION: NZ_CP022743.1
  ref <309>: DATABASE ENTRY DATE: 2019-04-01
  ref <313>: RELEVANT RESIDUES IN SEQ ID NO: (1)..(1531)
ttttacaatggagagtttgatcctggctcaggatgaacgctagcggcaggcctaatacatgcaagtcggacgggattggagagcttgctttccatgagagtggcgcacgggtgcgtaacacgtatgtaacctacccttatcagggggatagcctctcgaaagagagattaagcccgcataacattttaccctggcatcagggaataatcaaatatttataggataaggatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgtaccggaataaacctcattatgtataatgagctgaatgtacggtaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgaggcacgaaagcgtggggatcaaacaggattagataccctggtagtccacgccctaaacgatgaatactcgatgttagcgatatacagttagcgtcaaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaattgagcagagacgctcaagtccttcgggacacgaaactaggtgctgcatggctgtcgtcagctcgtgccgtgaggtgttgggttaagtcccgcaacgagcgcaacccctgtgtttagttgccagcacgtaatggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctcaaaaagctgttcacagttcggatcggggtctgcaactcgaccccgtgaagttggattcgctagtaatcgcagatcagcaatgctgcggtgaatacgttcccgggccttgtacacaccgcccgtcaagccatggaagctggaagtacctgaagtgcgtaaccgcaaggagcgtcctagggtaaagtcggtaactggggctaagtcgtaacaaggtagccgtaccggaaggtgtggctggaatacctcctttctgga

SEQ ID NO: 5834 - DNA, 1522 bp, Mucilaginibacter sp. F01003
  ref <308>: DATABASE ACCESSION NUMBER: NCBI ACCESSION: NZ_SBIW01000006.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcggcaggcctaatacatgcaagtcggacgggatttgggagcttgcttctgatgagagtggcgcacgggtgcgtaacacgtatgtaacctaccttaatctgggggatagcctctcgaaagagagattaacaccgcataacatcaccggatagcattttttggtgatcaaatatttataggattaagatgggcatgcggaacattagctagttggtaaggtaatggcttaccaaggctacgatgtttaggggatctgagaggatggccccccacactggtactgagacacggaccagactcctacgggaggcagcagtaaggaatattggtcaatgggcgcaagcctgaaccagccatgccgcgtgcaggaagacggccctatgggttgtaaactgcttttgtaccggaataaacccttttacgtgtaggaggttgaatgtacggtaagaataaggatcggctaactccgtgccagcagccgcggtaatacggaggatccgagcgttatccggatttattgggtttaaagggtgcgtaggcggcctattaagtcaggggtgaaagacggtagcttaactatcgcagtgcctttgatactgatgggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaatactcgatgttggcgatatacggccagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatccagagacggatcagctcttcggagcacgaaactaggtgctgcatggctgtcgtcagctcgtgccgtgaggtgttgggttaagtcccgcaacgagcgcaacccctatgtttagttgccagcacgttaaggtggggactctaaacagactgcctatgcaaatagagaggaaggaggggacgacgtcaagtcatcatggcccttacgtccggggctacacacgtgctacaatggatggtacagcgggctgctacctggcaacaggatgccaatctcgtaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgtaaggagcgtcctagggtaaagtcggtaactggggctaagtcgtaacaaggtagccgtaccggaaggtgtggctggaatacctccttt

SEQ ID NO: 5835 - DNA, 1519 bp, Mucilaginibacter sp. HYN0043
  ref <308>: DATABASE ACCESSION NUMBER: NCBI ACCESSION: NZ_CP032869.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcggacgggataggagagcttgctttccttgagagtggcgcacgggtgcgtaacacgtatgtaacctaccttagtcagggggatagcctctcgaaagagagattaagaccgcataacattatgatatggcatcgtattataatcaaatatttataggactaagatgggcatgcgcaacattagctagttggtgtggtaacggcataccaaggctacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgcaggggaataaaccttctttcgtgaaagaagctgaatgtactctgagaataaggatcggctaactccgtgccagcagccgcggtaatacggaggatccaagcgttatccggatttattgggtttaaagggtgcgtaggcggctttttaagtcaggggtgaaagacggtagcttaactatcgcagtgcccttgatactgaagagcttgaatgtagttgaggtaggcggaatgtgacaagtagcggtgaaatgcatagatatgtcacagaacaccaattgcgaaggcagcttactaagctatgattgacgctgaggcacgaaagcgtggggatcaaacaggattagataccctggtagtccacgccctaaacgatgaacactcgatgttggcgatatacagtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgtgtcagagacggcacagtccttcgggacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatgatacagagggcagctacctggcaacaggatgccaatctccaaaagtcattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5836 - DNA, 1530 bp, Mucilaginibacter sp. L294
  ref <308>: DATABASE ACCESSION NUMBER: NCBI ACCESSION: NZ_LGEK01000159.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcgaacgggattgagaagcttgcttttcatgagagtggcgcacgggtgcgtaacacgtatgtaacctaccttaatctgggggatagcctctcgaaagagagattaacaccgcataacattatcggatagcattttctgataatcaaatatttataggattaagatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaaccttttcacgtgtgagaagctgaatgtacggtaagaataaggatcggctaactccgtgccagcagccgcggtaatacggaggatccaagcgttatccggatttattgggtttaaagggtgcgtaggcggttctttaagtcaggggtgaaagacggtagcttaactatcgcagtgcctttgatactgaagaacttgaatacacttgaggtaggcggaatgtgacaagtagcggtgaaatgcatagatatgtcacagaacaccaattgcgaaggcagcttactaaagtgtcattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgagacagagacgtctcagtccttcgggacacgaaactaggtgctgcatggctgtcgtcagctcgtgccgtgaggtgttgggttaagtcccgcaacgagcgcaacccctgtgaatagttgccagcacgtaatggtggggactctattcagactgcctatgcaaatagagaggaaggaggggacgacgtcaagtcatcatggcccttacgtccggggctacacacgtgctacaatggatggtacagcgggcagctacctggcaacaggatgccaatctcgtaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgtaaggagcgtcctagggtaaagtcggtaactggggctaagtcgtaacaaggtagccgtaccggaaggtgtggctggaatacctcctttctggagc

SEQ ID NO: 5837 - DNA, 1525 bp, Mucilaginibacter sp. MYSH2
  ref <308>: DATABASE ACCESSION NUMBER: NCBI ACCESSION: NZ_QWDC01000014.1
  ref <309>: DATABASE ENTRY DATE: 2019-04-01
  ref <313>: RELEVANT RESIDUES IN SEQ ID NO: (1)..(1525)
acaatggagagtttgatcctggctcaggatgaacgctagcggcaggcctaatacatgcaagtcggacgggattgaggagcttgcttctcatgagagtggcgcacgggtgcgtaacacgtatgtaacctaccttagtcagggggatagcctctcgaaagagagattaacaccgcataacattatgatatggcatcatattataatcaaatatttataggactaagatgggcatgcggaacattagctagttggtaaggtaacggcttaccaaggcaacgatgtttaggggatctgagaggatgaccccccacactggtactgagacacggaccagactcctacgggaggcagcagtaaggaatattggtcaatggacgcaagtctgaaccagccatgccgcgtgcaggaagacggccctacgggttgtaaactgcttttgtaccggaataaacctttcctcgtgagggaagctgaatgtacggtaagaataaggatcggctaactccgtgccagcagccgcggtaatacggaggatccaagcgttatccggatttattgggtttaaagggtgcgtaggcggcctattaagtcaggggtgaaagacggtagcttaactatcgcagtgcctttgatactgatgggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgcctatgcaaatagagaggaaggaggggacgacgtcaagtcatcatggcccttacgtccggggctacacacgtgctacaatggatggtacagagggctgctacctggcaacaggatgccaatctcttaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtacctgaagtcggtaaccgcaaggagccgcctagggtaaagtcggtaactggggctaagtcgtaacaaggtagccgtaccggaaggtgtggctggaatacctcctttctg

SEQ ID NO: 5838 - DNA, 1525 bp, Mucilaginibacter sp. NFR10
  ref <308>: DATABASE ACCESSION NUMBER: NCBI ACCESSION: NZ_FMTV01000021.1
  ref <309>: DATABASE ENTRY DATE: 2019-04-01
  ref <313>: RELEVANT RESIDUES IN SEQ ID NO: (1)..(1525)
tacaatggagagtttgatcctggctcaggatgaacgctagcggcaggcctaatacatgcaagtcggacgggatttgggagcttgctcctaatgagagtggcgcacgggtgcgtaacacgtatgtaacctaccttgatcagggggatagcctctcgaaagagagattaagaccgcataacattatgatatggcatcgtattataatcaaatatttataggatcaagatgggcatgcgcaacattagctagttggtgtggtaacggcataccaaggcgacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgcaggggaataaaccccggttcgtgaaccgggttgaatgtaccttgagaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgtgacagagacgtcacagttcttcggaacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatggtacagagggcagctacctggcaacaggatgccaatctcataaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctg

SEQ ID NO: 5839 - DNA, 1520 bp, Mucilaginibacter sp. OK098
  ref <308>: DATABASE ACCESSION NUMBER: NCBI ACCESSION: NZ_FRCM01000005.1
  ref <309>: DATABASE ENTRY DATE: 2019-04-01
  ref <313>: RELEVANT RESIDUES IN SEQ ID NO: (1)..(1520)
tggagagtttgatcctggctcaggatgaacgctagcggcaggcctaatacatgcaagtcggacgggattggagagcttgctttccatgagagtggcgcacgggtgcgtaacacgtatgtaacctacccttatcagggggatagcctctcgaaagagagattaagcccgcataatatgaagacacagcattgtgatttcatcaaatatttataggataaggatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaaccacagttcgtgaattgtgctgaatgtacggtaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgaggcacgaaagcgtggggatcaaacaggattagataccctggtagtccacgccctaaacgatgaatactcgatgttagcgatatacagttagcgtcaaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatacagagacgtatcagtccttcgggacacgaaactaggtgctgcatggctgtcgtcagctcgtgccgtgaggtgttgggttaagtcccgcaacgagcgcaacccctatgtttagttgccagcacgttaaggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctcaaaaagctgttcacagttcggatcggggtctgcaactcgaccccgtgaagttggattcgctagtaatcgcagatcagcaatgctgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5840 - DNA, 1530 bp, Mucilaginibacter sp. OK268
  ref <308>: DATABASE ACCESSION NUMBER: NCBI ACCESSION: NZ_FNJV01000018.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcggacgggattggagagcttgctttccatgagagtggcgcacgggtgcgtaacacgtatgtaacctaccttgttcagggggatagcctctcgaaagagagattaagaccgcataacattgcaatgtggcatcacaaagcaatcaaatatttataggaacaagatgggcatgcggaacattagctagttggtaaggtaacggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctatgggttgtaaactgcttttatacgggaataaaccttgatacgtgtatcaagctgaatgtactgtaagaataaggatcggctaactccgtgccagcagccgcggtaatacggaggatccaagcgttatccggatttattgggtttaaagggtgcgtaggtggttctttaagtcaggggtgaaagacggcagcttaactgtcgcagtgcctttgatactgaagaacttgaatccactagaggtaggcggaatgtgacaagtagcggtgaaatgcatagatatgtcacagaacaccaattgcgaaggcagcttactatggtggtattgacactgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaataaagcagagacgctttagtccttcgggacacgaaactaggtgctgcatggctgtcgtcagctcgtgccgtgaggtgttgggttaagtcccgcaacgagcgcaacccctatgtttagttgccagcacgtcaaggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctcataaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgtaaggagcgtcctagggtaaagtcggtaactggggctaagtcgtaacaaggtagccgtaccggaaggtgtggctggaatacctcctttctggagc

SEQ ID NO: 5841 - DNA, 1529 bp, Mucilaginibacter sp. OK283
  ref <308>: DATABASE ACCESSION NUMBER: NCBI ACCESSION: NZ_FODR01000027.1
  ref <309>: DATABASE ENTRY DATE: 2019-04-01
  ref <313>: RELEVANT RESIDUES IN SEQ ID NO: (1)..(1529)
ttttacaatggagagtttgatcctggctcaggatgaacgctagcggcaggcctaatacatgcaagtcggacgggataggagagcttgctttccttgagagtggcgcacgggtgcgtaacacgtatgtaacctaccttgttcagggggatagcctctcgaaagagagattaagaccgcataacattatgatatggcatcgtattataatcaaatatttataggaacaagatgggcatgcggaacattagctagttggtaaggtaacggcttaccaaggctacgatgtttaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgtacgggaataaaccttgattcgtgaatcaagctgaatgtactgtaagaataaggatcggctaactccgtgccagcagccgcggtaatacggaggatccaagcgttatccggatttattgggtttaaagggtgcgtaggtggcttattaagtcaggggtgaaagacggtagcttaactatcgcagtgcctttgatactgatgagcttgaatgaactagaggtaggcggaatgtgacaagtagcggtgaaatgcatagatatgtcacagaacaccaattgcgaaggcagcttactatggttagattgacactgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaattgagcagagacgctcaagtccttcgggacacgaaactaggtgctgcatggctgtcgtcagctcgtgccgtgaggtgttgggttaagtcccgcaacgagcgcaacccctatgtttagttgccagcacgttaaggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctccaaaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctg

SEQ ID NO: 5842 - DNA, 1523 bp, Mucilaginibacter sp. OV119
  ref <308>: DATABASE ACCESSION NUMBER: NCBI ACCESSION: NZ_QKLV01000034.1
  ref <309>: DATABASE ENTRY DATE: 2019-04-01
  ref <313>: RELEVANT RESIDUES IN SEQ ID NO: (1)..(1523)
acaatggagagtttgatcctggctcaggatgaacgctagcggcaggcctaatacatgcaagtcggacgggataggagagcttgctttccttgagagtggcgcacgggtgcgtaacacgtatgtaacctaccttagtcagggggatagcctctcgaaagagagattaagaccgcataacatcacggaatggcatcgttttgtgatcaaatatttataggactaagatgggcatgcgcaacattagctagttggtgtggtaacggcataccaaggctacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgcaggggaataaacctcgatacgtgtatcgagttgaatgtaccttgagaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgtgacagagacgtcacagttcttcggaacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatggatggtacagagggcagctacctggcaacaggatgccaatctcttaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5843 - DNA, 1530 bp, Mucilaginibacter sp. PAMC 26640
  ref <308>: DATABASE ACCESSION NUMBER: NCBI ACCESSION: NZ_CP014773.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcggacgggatttgggagcttgctcctgatgagagtggcgcacgggtgcgtaacacgtatgtaacctaccttaatctgggggatagcctctcgaaagagagattaacaccgcataacatcacattgcggcattgcagagtgatcaaatatttataggattaagatgggcatgcggaacattagctagttggtaaggtaatggcttaccaaggctacgatgtttaggggatctgagaggatgaccccccacactggtactgagacacggaccagactcctacgggaggcagcagtaaggaatattggtcaatgggcggaagcctgaaccagccatgccgcgtgcaggaagacggccctacgggttgtaaactgcttttgtaccggaataaacctttcttcgtgaagagagctgaatgtacggtaagaataaggatcggctaactccgtgccagcagccgcggtaatacggaggatccgagcgttatccggatttattgggtttaaagggtgcgtaggcggccagttaagtcaggggtgaaagacggtagctcaactatcgcagtgcctttgatactgacgggcttgaatacacttgaggtaggcggaatgtgacaagtagcggtgaaatgcatagatatgtcacagaacaccaattgcgaaggcagcttactaaagtgtgattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatccagagacggatcagctcttcggagcacgaaactaggtgctgcatggctgtcgtcagctcgtgccgtgaggtgttgggttaagtcccgcaacgagcgcaacccctatgtttagttgccagcacgttaaggtggggactctaaacagactgcctatgcaaatagagaggaaggaggggacgacgtcaagtcatcatggcccttacgtccggggctacacacgtgctacaatggatggtacagcgggcagctacctggcaacaggatgccaatctcgtaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgtaaggagcgtcctagggtaaagtcggtaactggggctaagtcgtaacaaggtagccgtaccggaaggtgtggctggaatacctcctttctggagc

SEQ ID NO: 5844 - DNA, 1520 bp, Mucilaginibacter sp. PPCGB 2223
  ref <308>: DATABASE ACCESSION NUMBER: NCBI ACCESSION: NZ_MDJS01000007.1
  ref <309>: DATABASE ENTRY DATE: 2019-04-01
  ref <313>: RELEVANT RESIDUES IN SEQ ID NO: (1)..(1520)
tggagagtttgatcctggctcaggatgaacgctagcggcaggcctaatacatgcaagtcggacgggatttgggagcttgctcctaatgagagtggcgcacgggtgcgtaacacgtatgtaacctacctttatcagggggatagcctctcgaaagagagattaagaccgcataacattataacacagcattgtgatataatcaaatatttataggataaagatgggcatgcgggacattagctagttggcggggtaacggcccaccaaggcgacgatgtctaggggatctgagaggatggccccccacactggtactgagacacggaccagactcctacgggaggcagcagtaaggaatattggtcaatggacggaagtctgaaccagccatgccgcgtgcaggaagacggccctatgggttgtaaactgcttttgcaggggaataaacctcccgacgtgtcgggagctgaatgtactctgagaataaggatcggctaactccgtgccagcagccgcggtaatacggaggatccgagcgttatccggatttattgggtttaaagggtgcgtaggcggcctattaagtcaggggtgaaagacggtagcttaactatcgcagtgcctttgatactgatgggcttgaatacactagaggtaggcggaatgtgacaagtagcggtgaaatgcatagatatgtcacagaacaccaattgcgaaggcagcttactatggtgcaattgacgctgaggcacgaaagcgtggggatcaaacaggattagataccctggtagtccacgccctaaacgatgaacactcgatgttagcgatatacagttagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgattcagagacggatcagtccttcgggacacgaaactaggtgctgcatggctgtcgtcagctcgtgccgtgaggtgttgggttaagtcccgcaacgagcgcaacccctatgtttagttgccagcacgtcaaggtggggactctaaacagactgcctacgcaagtagagaggaaggaggggacgacgtcaagtcatcatggcccttacgtccggggctacacacgtgctacaatggatggtacagagggcagctacctggcaacaggatgccaatctccaaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctgggggtacctgaagtcggtaaccgcaaggagccgcctagggtaaaaccggtaactggggctaagtcgtaacaaggtagccgtaccggaaggtgcggctggaatacctcctttct

SEQ ID NO: 5845 - DNA, 1520 bp, Mucilaginibacter sp. YBJ-36
  ref <308>: DATABASE ACCESSION NUMBER: NCBI ACCESSION: NZ_SACK01000019.1
  ref <309>: DATABASE ENTRY DATE: 2019-04-01
  ref <313>: RELEVANT RESIDUES IN SEQ ID NO: (1)..(1520)
tggagagtttgatcctggctcaggatgaacgctagcggcaggcctaatacatgcaagtcgaacgggattggggagcttgctccccatgagagtggcgcacgggtgcgtaacacgtatgcaacctacctttaccagggggatagcctctcgaaagagagattaagaccgcataacattatgatatggcatcgtattataatcaaatatttatagggtaaagatgggcatgcggaacattagctagttggtgtggtaacggcataccaaggcgacgatgtttaggggatctgagaggatgaccccccacactggtactgagacacggaccagactcctacgggaggcagcagtaaggaatattggtcaatgggcggaagcctgaaccagccatgccgcgtgcaggaagacggccctatgggttgtaaactgcttttgtaccggaataaaccttgatacgtgtatcaagctgaatgtacggtaagaataaggatcggctaactccgtgccagcagccgcggtaatacggaggatccgagcgttatccggatttattgggtttaaagggtgcgtaggcggctaattaagtcaggggtgaaagacggcagctcaactgtcgcagtgcctttgatactgattggcttgaatacacttgaggtaggcggaatgtgacaagtagcggtgaaatgcatagatatgtcacagaacaccaattgcgaaggcagcttactaaagtgtgattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatggagcagagacgctccagtccttcgggacacgaaactaggtgctgcatggctgtcgtcagctcgtgccgtgaggtgttgggttaagtcccgcaacgagcgcaacccctgtgtttagttgccagcatgtaatggtggggactctaaacagactgcctatgcaaatagagaggaaggaggggacgacgtcaagtcatcatggcccttacgtccggggctacacacgtgctacaatgggcagtacagagggcagctacctggcaacaggatgccaatctcataaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5846 - DNA, 1523 bp, Mucilaginibacter sp. YR332
  ref <308>: DATABASE ACCESSION NUMBER: NCBI ACCESSION: NZ_RCCR01000005.1
  ref <309>: DATABASE ENTRY DATE: 2019-04-01
  ref <313>: RELEVANT RESIDUES IN SEQ ID NO: (1)..(1523)
acaatggagagtttgatcctggctcaggatgaacgctagcggcaggcctaatacatgcaagtcggacgggataggagagcttgctttccttgagagtggcgcacgggtgcgtaacacgtatgtaacctaccttgatcagggggatagcctctcgaaagagagattaagaccgcataacattatgttgtggcatcgcaatataatcaaatatttataggatcaagatgggcatgcggaacattagctagttggtaaggtaacggcttaccaaggctacgatgtttaggggatctgagaggatgaccccccacactggtactgagacacggaccagactcctacgggaggcagcagtaaggaatattggtcaatggacggaagtctgaaccagccatgccgcgtgcaggaagacggccctacgggttgtaaactgcttttgtaccggaataaaccttgatacgtgtatcaagctgaatgtacggtaagaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagttcttcggaacacgaaactaggtgctgcatggctgtcgtcagctcgtgccgtgaggtgttgggttaagtcccgcaacgagcgcaacccctatgtttagttgccagcatttaaggtggggactctaaacagactgcctatgcaaatagagaggaaggaggggacgacgtcaagtcatcatggcccttacgtccggggctacacacgtgctacaatgggcagtacagagggccgctacctggcaacaggatgccaatctcttaaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5847 - DNA, 1524 bp, Mucilaginibacter sp. ZH6
  ref <308>: DATABASE ACCESSION NUMBER: NCBI ACCESSION: NZ_QWDE01000009.1
  ref <309>: DATABASE ENTRY DATE: 2019-04-01
  ref <313>: RELEVANT RESIDUES IN SEQ ID NO: (1)..(1524)
acaatggagagtttgatcctggctcaggatgaacgctagcggcaggcctaatacatgcaagtcggacgggatttgggagcttgctcctgatgagagtggcgcacgggtgcgtaacacgtatgtaacctaccttgttcagggggatagcctctcgaaagagagattaacaccgcataaaatatcgatgtggcatcacaatgatatcaaatatttataggaacaagatgggcatgcggaacattagctagttggtaaggtaacggcttaccaaggctacgatgtttaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaacccttttacgtgtaagaggctgaatgtacggtaagaataaggatcggctaactccgtgccagcagccgcggtaatacggaggatccgagcgttatccggatttattgggtttaaagggtgcgtaggcggcctattaagtcaggggtgaaagacggtagctcaactatcgcagtgcctttgatactgatgggcttgaatacacttgaggtaggcggaatgtgacaagtagcggtgaaatgcatagatatgtcacagaacaccaattgcgaaggcagcttactaaagtgtgattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgcctatgcaaatagagaggaaggaggggacgacgtcaagtcatcatggcccttacgtccggggctacacacgtgctacaatgggcagtacagagggcagctacctggcaacaggatgccaatctccaaaagctgttcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttct

SEQ ID NO: 5848 - DNA, 1524 bp, Mucilaginibacter yixingensis
  ref <308>: DATABASE ACCESSION NUMBER: NCBI ACCESSION: NZ_QAOQ01000016.1
  ref <309>: DATABASE ENTRY DATE: 2019-04-01
  ref <313>: RELEVANT RESIDUES IN SEQ ID NO: (1)..(1524)
acaatggagagtttgatcctggctcaggatgaacgctagcggcaggcctaatacatgcaagtcggacgggattgaggagcttgctcctcatgagagtggcgcacgggtgcgtaacacgtatgtaacctaccttgttcagggggatagcctctcgaaagagagattaagaccgcataaaatcacactatggcatcatagaatgatcaaatatttataggaacaagatgggcatgcggaacattagctagttggtaaggtaacggcttaccaaggctacgatgtttaggggatctgagaggatggccccccacactggtactgagacacggaccagactcctacgggaggcagcagtaaggaatattggtcaatgggcggaagcctgaaccagccatgccgcgtgcaggaagacggccctacgggttgtaaactgcttttgtaccggaataaacctacttacgtgtaagtagctgaatgtacggtaagaataaggatcggctaactccgtgccagcagccgcggtaatacggaggatccgagcgttatccggatttattgggtttaaagggtgcgtaggcggcctattaagtcaggggtgaaagacggtagctcaactatcgcagtgcccttgatactgatgggcttgaatgcagctgaggtaggcggaatgtgacaagtagcggtgaaatgcatagatatgtcacagaacaccgattgcgaaggcagcttactaaagtgcgattgacgctgaggcacgaaagcgtggggatcaaacaggattagataccctggtagtccacgccctaaacgatgaatactcgatgttggcgatatacggtcagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatagagcagagacgctctagtccttcgggacacgaaactaggtgctgcatggctgtcgtcagctcgtgccgtgaggtgttgggttaagtcccgcaacgagcgcaacccctatgtttagttgccagcacataatggtggggactctaaacagactgcctacgcaagtagagaggaaggaggggacgacgtcaagtcatcatggcccttacgtccggggctacacacgtgctacaatgggccatacagagggcagcaacctggcaacaggaagccaatctcaaaaagtggttcacagttcggatcggggtctgcaactcgaccccgtgaagttggattcgctagtaatcgcagatcagcaatgctgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgcggctggaatacctcctttct

SEQ ID NO: 5849 - DNA, 1559 bp, Mucispirillum schaedleri
  ref <308>: DATABASE ACCESSION NUMBER: NCBI ACCESSION: NZ_FTRD01000003.1
  ref <309>: DATABASE ENTRY DATE: 2019-04-01
  ref <313>: RELEVANT RESIDUES IN SEQ ID NO: (1)..(1559)
tttgtatggagagtttgatcctggctcagaacgaacgctggcggcgtgcttaacacatgcaagtcagggagaaagtctcttcggggatgattaaaccggcgcacgggtgagtaacacgtgagtgacctgccttttagactggaacaacttaccgaaaggtgagctaatgccggatgagttatataagtgcatgtttatataggaaaagttggggagacctgacgctgaaagatggactcgcgtcccattagctagttggtagggtaatggcctaccaaggcgacgatgggtagccggcctgagagggtggccggccacactgggactgagacacggcccagactcctacgggaggcagcagtggggaattttgcgcaatgctcgtaagagtgacgcagcgacgccgcgtgaatgacgaaggccttcgggtcgtaaagttctttcgacagggaagaaaatgcctataagtaactgtgtatgtattgacggtacctgtataagcagccccggctaactccgtgccagcagccgcggtaatacggagggggcgagcgttgttcggagtgactgggcgtaaagagcacgtaggcggtgttgtaagtcattagtcaaagactagagctcaactttagtaaggctagtgatactataatactagagtatcagagaggattgcagaattcctggtgtagcggtgaaatgcgtagatatcaggaggaataccgttagcgaaggcggcaatctggctggaaactgacgctgaggtgcgaaagcgtgggtagcaaacaggattagataccctggtagtccacgctgtaaacgatggatgctaggtgttgggcttttaagttcagtgccgcagcaaacgcgataagcatcccgcctggggagtacgtttgcaagaatgaaactcaaaggaattgacgggggcccgcacaagcggtggagcacgtggtttaattcgatgctaaccgaagaaccttacctgggtttgacatccacagaaggcgttagagataatgctgtgcctgatttatcaggagctgtgagacaggtgctgcatggctgtcgtcagctcgtgccgtgaggtgttgggttaagtcccgcaacgagcgcaacccctatttccagttgctaacggttgaagctgagcactctggagagactgccagcgataagctggaggaaggtggggacgacgtcaagtcatcatggcccttatgtccagggctacacacgtgctacaatggcataatcagagggaagcatctccgcaaggataagcgaatctcataaattatgtctcagttcagattgcagtctgcaactcgactgcatgaagtcggaatcgctagtaatcgcagatcagcaaagctgcggtgaatacgttcccgggccttgtacacaccgcccgtcacaccacgggagtcggtcgcgcctgaagccggtggcctatcagtaatgggggagccgtctatggcgagattggtaactggggtgaagtcgtaacaaggtagccgtaccggaaggtgtggctggatcacctcctttctaaggaa

SEQ ID NO: 5850 - DNA, 1529 bp, Muricauda sp. ES.050
  ref <308>: DATABASE ACCESSION NUMBER: NCBI ACCESSION: NZ_PHUD01000001.1
  ref <309>: DATABASE ENTRY DATE: 2019-04-01
  ref <313>: RELEVANT RESIDUES IN SEQ ID NO: (1)..(1529)
acaatgaagagtttgatcctggctcaggatgaacgctagcggcaggcctaacacatgcaagtcgaggggtaacatgagaaagcttgcttttttgatgacgaccggcgcacgggtgcggaacgcgtatggaacctgcccctgtcaggggaatagcccagggaaacttggattaatgccccatggtatcgttttatcgcatgataaggtgattaaagatttatcggacagggatggccatgcgtaccattagttagttggtgaggtaacggcttaccaaggcagcgatggttaggggccctgagagggggatcccccacactggtactgagacacggaccagactcctacgggaggcagcagtgaggaatattggacaatggaggagactctgatccagccatgccgcgtgcaggatgacggccctatgggttgtaaactgcttttatacgggaagaaacgcacctacgtgtaggtgtctgacggtaccgtaagaataaggaccggctaactccgtgccagcagccgcggtaatacggagggtccgagcgttatccggaatcattgggtttaaagggtccgtaggcgggcctgtaagtcaggggtgaaagtttgtggctcaaccataaaattgcctttgatactgcaggtcttgagtcatggtgaggttgccggaacatgtggtgtagcggtgaaatgcatagatatcacatagaacaccgatcgcgaaggcaggtgaccaaccatgtactgacgctgatggacgaaagcgtgggtagcgaacgggattagataccccggtagtccacgccgtaaacgatggatactagctgtggggacttcggtctccgtggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgcaggctgcatggggtggagacacccctttcttcggactgcctgcaaggtgctgcatggttgtcgtcagctcgtgccgtgaggtgtcaggttaagtcctataacgagcgcaacccctaccgttagttgccagcatgtaaagatggggactctaacgggactgccggtgcaaaccgtgaggaaggtggggacgacgtcaaatcatcacggcccttacgtcctgggctacacacgtgctacaatggccggtacagagggaagccaccccgcaagggggcgcggatctacaaaaccggtcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaaaatcggtaactagggctaagtcgtaacaaggtagccgtaccggaaggtgcggctggaacacctcctttcta

SEQ ID NO: 5851 - DNA, 1531 bp, Myceligenerans xiligouense
  ref <308>: DATABASE ACCESSION NUMBER: NCBI ACCESSION: NZ_RKQZ01000001.1
  ref <309>: DATABASE ENTRY DATE: 2019-04-01
  ref <313>: RELEVANT RESIDUES IN SEQ ID NO: (1)..(1531)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccccctcttcgggataagccttggaaacggggtctaataccggatattcagtctctgccgcatggtgggggttggaaagatttattggtgggggatgggctcgcggcctatcagcttgttggtggggtgatggcctaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacaaggaagaagctttcgggtgacggtacttgtagaagaagcgccggctaactacgtgccagcagccgcggtaatacgtagggcgcaagcgttgtccggaattattgggcgtaaagagctcgtaggcggtctgtcgcgtctggtgtgaaaacccgaggctcaacctcgggctggcatcgggtacgggcaggctggagtgcggtaggggagactggaattcctggtgtagcggtggaatgcgcagatatcaggaggaacaccgatggcgaaggcaggtctctgggccgttactgacgctgaggagcgaaagcatggggagcgaacaggattagataccctggtagtccatgccgtaaacgttgggcactaggtgtggggcgggttccactcgttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggacagctgcagagatgtggtttccgcaaggtcggtgtacaggtggtgcatggttgtcgtcagctcgtgtcgtgagatgttgggttaagtcccgcaacgagcgcaacccttatcctatgttgccagcgggttatgccggggactcatgggagactgccggggtcaactcggaggaaggtggggatgacgtcaaatcatcatgccccttatgtcttgggcttcacgcatgctacaatggccggtacagagggttgcgatatcgtgaggtggagcgaatccctaaaagccggtctcagttcggatcggggtctgcaactcggccccgtgaagtcggagtcgctagtaatcgcagatcagcaacgctgcggtgaatacgttcccgggccttgtacacaccgcccgtcaagtcacgaaagttggtaacacccgaagctcacggctcaacccttcggggagggagtggtcgaaggtgggactggcgattgggactaagtcgtaacaaggtagccgtaccggaaggtgcggctggatcacctcctttctaagga

SEQ ID NO: 5852 - DNA, 1530 bp, Mycetocola lacteus
  ref <308>: DATABASE ACCESSION NUMBER: NCBI ACCESSION: NZ_RCUY01000020.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagctggagcttgctctggtggattagtggcgaacgggtgagtaacacgtgagtaacctgccctccactctgggataagcgctggaaacggcgtctaataccggatatgaatctccaccgcatggtgggggttggaaagaatttcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagatgtagggtccattccacggattctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgtaaggtcggtatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccagtacaatgggctgcgataccgcaaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgacgccggtggcctaaccccttgtgggagggagccgtctaaggtgggattggtaattaggactaagtcgtaacaaggtagccgtaccggaaggtgcggctggatcacctcctttctaagga

SEQ ID NO: 5853 - DNA, 1530 bp, Mycetocola manganoxydans
  ref <308>: DATABASE ACCESSION NUMBER: NCBI ACCESSION: NZ_RCUV01000028.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaactccagcttgctggggggattagtggcgaacgggtgagtaacacgtgagtaacctgcccttgactctgggataagcgttggaaacgacgtctaataccggatacgaccagccccggcatcgggtgttggtggaaagaattttggtcaaggatggactcgcggcctatcaggtagttggtgaggtaatggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggcgagagatcgtcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgacgccggtggcctaaccctttattgggagggagccgtctaaggtgggattggtaattaggactaagtcgtaacaaggtagccgtaccggaaggtgcggctggatcacctcctttctaagga

SEQ ID NO: 5854 - DNA, 1528 bp, Mycetocola sp. 449
  ref <308>: DATABASE ACCESSION NUMBER: NCBI ACCESSION: NZ_CP026949.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacgatgaaggagagcttgctctccggattagtggcgaacgggtgagtaacacgtgagtaacctgcccttgactctgggataagcgttggaaacgacgtctaataccggatacgaaccgcgaaggcatcttcagtggttggaaagaactttggtcaaggatggactcgcggcctatcaggtagttggtgaggtaatggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagggtggggagcaaacaggcttagataccctggtagtccaccccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgcgcgagagatcgtgaactctttggacactcgtatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgcgaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgacgccggtggcctaaccctttattgggagggagccgtctaaggtgggattggtaattaggactaagtcgtaacaaggtagccgtaccggaaggtgcggctggatcacctcctttcta

SEQ ID NO: 5855 - DNA, 1535 bp, Mycoavidus cysteinexigens
  ref <308>: DATABASE ACCESSION NUMBER: NCBI ACCESSION: NZ_AP018150.1
  ref <309>: DATABASE ENTRY DATE: 2019-04-01
  ref <313>: RELEVANT RESIDUES IN SEQ ID NO: (1)..(1535)
attaaacagaagagtttgatcctggctcagattgaacgctggcggcatgctttacacatgcaagtcgaacggcagcgcgggtttcggcctggcggcgagtggcgaacgggtgagtaatacatcggaacgtgtcctgtagagggggatagcccggcgaaagccggattaataccgcatacgatctacggatgaaagcgggggaccttcgggcctcgcgctataggggcggccgatgtcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgttcgggaagaaagcgttagggtaaataatcttaatgtatgacggtaccgaaagaataagcaccggctaactacgtgccagcagccgcggtaatacgtagggtgcaagcgttaatcggaattattgggcgtaaagggtgcgtaggcggtttgttaagacggatgtgaaatccctgggctcaacctgggaactgcatacgtgactggcagactagagtatggcagagggaggtggaattccacgtgtagcagtgaaatgcgtagatatgtggaggaacaccgatggcgaaggcagcctcctgggccaatactgacgctgaggcacgaaagcgtggggagcaaacaggattagataccctggtagtccacgccctaaacgatgtcaactggttgttggggatagctatccttagtaacgaagctaacgcgtgaagttgaccgcctggggagtacgatcgcaagattaaaactcaaaggaattgacggggacccgcacaagcggtggatgatgtggattaattcgatgcaacgcgaaaaaccttacctacccttgacatgtacataatctggctgagaggtcagagtgctcgaaagagagatgtaacacaggtgctgcatggctgtcgtcagctcgtgtcgtgagatgttgggttaagtcccgcaacgagcgcaacccttatccttagttgctacgcaagggcactctaaggagactgccggtgacaaaccggaggaaggtggggatgatgtcaagtcctcatggcccttatgggtagggcttcacacgtcatacaatggtcggtacagagggctgcaaacccgcgagggggagccaatctcagaaagccgatcgtagtccggattgcagtctgcaactcgactgcatgaagttggaatcgctagtaatcgcggatcagcatgccgcggtgaatacgttcccgggtcttgtacacaccgcccgtcacaccatgggagtgggttttaccagaagtggctagtctaaccgtaaggagggcggtcaccacggtaggattcatgactggggtgaagtcgtaacaaggtagccgtatcggaaggtgcggctggatcacctcctttc

SEQ ID NO: 5856 - DNA, 1543 bp, Mycobacteriaceae bacterium 1482268.1
  ref <308>: DATABASE ACCESSION NUMBER: NCBI ACCESSION: NZ_LZSH01000289.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 5857 - DNA, 1543 bp, Mycobacterium decipiens
  ref <308>: DATABASE ACCESSION NUMBER: NCBI ACCESSION: NZ_NCXP01000009.1
  ref <309>: DATABASE ENTRY DATE: 2019-04-01
  ref <313>: RELEVANT RESIDUES IN SEQ ID NO: (1)..(1543)
ttgtttggagagtttgatcctggctcaggacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccgaataggaccacaggattcatgtcttgtggtggaaagcgatttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaaggag

SEQ ID NO: 5858 - DNA, 1523 bp, Mycobacterium grossiae
  ref <308>: DATABASE ACCESSION NUMBER: NCBI ACCESSION: NZ_MCHX01000007.1
  ref <309>: DATABASE ENTRY DATE: 2019-04-01
  ref <313>: RELEVANT RESIDUES IN SEQ ID NO: (1)..(1523)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccggataggactacggcctgcatgggttgtggtggaaagtttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagcacagacgaagcgcaagtgacggtatgtgcagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtcatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccctttgggagggagccgtcgaaggtgggatcggcgattgggacgaagtcgtaacaaggtagccgtaccggaaggtgcggctggatcacctcctttctaa

SEQ ID NO: 5859 - DNA, 1540 bp, Mycobacterium intracellulare
  ref <308>: DATABASE ACCESSION NUMBER: NCBI ACCESSION: NZ_PSQD01000132.1
  ref <309>: DATABASE ENTRY DATE: 2019-04-01
  ref <313>: RELEVANT RESIDUES IN SEQ ID NO: (1)..(1540)
ttgtttggagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggacctttaggcgcatgtctttaggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttctaaggag

SEQ ID NO: 5860 - DNA, 1540 bp, Mycobacterium kansasii
  ref <308>: DATABASE ACCESSION NUMBER: NCBI ACCESSION: NZ_UPHI01000108.1
  ref <309>: DATABASE ENTRY DATE: 2019-04-01
  ref <313>: RELEVANT RESIDUES IN SEQ ID NO: (1)..(1540)
ttgtttggagagtttgatcctggctcaggacgaacgctggcggcgtgcttaacacatgcaagtcgaacggaaaggtctcttcggagacactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaaggag

SEQ ID NO: 5861 - DNA, 1525 bp, Mycobacterium kyogaense
  ref <308>: DATABASE ACCESSION NUMBER: NCBI ACCESSION: NZ_QJUA01000085.1
  ref <309>: DATABASE ENTRY DATE: 2019-04-01
  ref <313>: RELEVANT RESIDUES IN SEQ ID NO: (1)..(1525)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccggataggaccacggcattcatgtgctgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggagaagaaggaccggccaactacgtgccagcagccgcggtaatacgtagggtccgagcgttgtccggaattactgggcgtaaagagctcgtaggtggtttgtcgcgttgttcgtgaaaactcacaactcaattgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5862 - DNA, 1554 bp, Mycobacterium leprae
  ref <308>: DATABASE ACCESSION NUMBER: NCBI ACCESSION: NZ_AP014567.1
  ref <309>: DATABASE ENTRY DATE: 2019-04-01
  ref <313>: RELEVANT RESIDUES IN SEQ ID NO: (1)..(1554)
ttgtttggagagtttgatcctggctcaggacgaacgctggcggcgtgcttaacacatgcaagtcgaacggaaaggtctctaaaaaatcttttttagagatactcgagtggcgaacgggtgagtaacacgtgggtaatctgccctgcacttcagggataagcttgggaaactgggtctaataccggataggacttcaaggcgcatgtcttgtggtggaaagctttttgcggtgcaggatgggcccgcggcttatcagcttgttggtggggtgacggcctaccaaggcgacgacgggtagccggcctgagagggtgtacggccacactgggactgagatacggcccagactcctacgggaggcagcagtggggaatattgcacaatgggcgcaagcctgatgcagcgacgccgcgtgggggatgacggctttcgggttgtaaacctctttcaccatcgacgaaggtctgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccagtggcgaaggcgggtctctgggcagtaactgacgctgaggagcgaaagcgtggggagcaaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggatgcgtctagagataggcactcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccgcggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtccaaggtgggatcggcgattgggacgaagtcgtaacaaggtagccgtaccggaaggtgcggctggatcacctcctttctaaggag

SEQ ID NO: 5863 - DNA, 1542 bp, Mycobacterium lepraemurium
  ref <308>: DATABASE ACCESSION NUMBER: NCBI ACCESSION: NZ_CP021238.1
  ref <309>: DATABASE ENTRY DATE: 2019-04-01
  ref <313>: RELEVANT RESIDUES IN SEQ ID NO: (1)..(1542)
ttgcttggagagtttgatcctggctcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctcaagacgcatgtcttctggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaggcctgatgcagcgacgccgcgtgggggatgacggccttcgggttgtaaacctctttcactatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggggactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtcgcctaacccttttgggagggagctgtcgaaggtgggatcggcgattgggacgaagtcgtaacaaggtagccgtaccggaaggtgcggctggatcacctcctttctaaggag

SEQ ID NO: 5864 - DNA, 1543 bp, Mycobacterium liflandii
  ref <308>: DATABASE ACCESSION NUMBER: NCBI ACCESSION: NC_020133.1
  ref <309>: DATABASE ENTRY DATE: 2019-04-01
  ref <313>: RELEVANT RESIDUES IN SEQ ID NO: (1)..(1543)
tttttgtttggagagtttgatcctggctcaggacgaacgctggcggcgtgcttaacacatgcaagtcgaacggaaaggtctcttcggagacactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcggaagcctgatgcagcgacgccgcgtgggggatgacggccttcgggttgtaaacctctttcaccatcgacgaaggttcgggttttctcggattgacggtagatggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaaggag

SEQ ID NO: 5865 - DNA, 1535 bp, Mycobacterium marinum
  ref <308>: DATABASE ACCESSION NUMBER: NCBI ACCESSION: NZ_AP018496.1
  ref <309>: DATABASE ENTRY DATE: 2019-04-01
  ref <313>: RELEVANT RESIDUES IN SEQ ID NO: (1)..(1535)
ttgtttggagagtttgatcctggctcaggacgaacgctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctgggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaa

SEQ ID NO: 5866 - DNA, 1539 bp, Mycobacterium paragordonae
  ref <308>: DATABASE ACCESSION NUMBER: NCBI ACCESSION: NZ_CP025546.1
  ref <309>: DATABASE ENTRY DATE: 2019-04-01
  ref <313>: RELEVANT RESIDUES IN SEQ ID NO: (1)..(1539)
ttgtttggagagtttgattctggctcaggacgaacgctggcggcgtgcttaacacatgcaagtcgaacggtaaggcccttcggggtacacgagtggcgaacgggtgagtaacacgtgggtaatctgccctgcacatcgggataagcctgggaaactgggtctaataccgaataggaccacagaacacatgtcctgtggtggaaagcttttgcggtgtgggatgggcccgcggcctatcagcttgttggtggggtgatggcccaccaaggcgacgacgggtagccggcctgagagggtgtccggccacactgggactgagatacggcccagactcctacgggaggcagcagtggggaatattgcacaatgggcgaaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaaggag

SEQ ID NO: 5867 - DNA, 1526 bp, Mycobacterium parascrofulaceum
  ref <308>: DATABASE ACCESSION NUMBER: NCBI ACCESSION: NZ_GG770554.1
  ref <309>: DATABASE ENTRY DATE: 2019-04-01
  ref <313>: RELEVANT RESIDUES IN SEQ ID NO: (1)..(1526)
ttttgtttggagagtttgatcctggctcaggacgaacgctggcggcgtgcttaacacatgcaagtcgaacggaaaggtctcttcggagatactcgagtggcgaacgggtgagtaacacgtgggcaatctgccctgcacttcgggataagcctgggaaactgggtctaataccggataggaccacttggcgcatgccttgtggtggaaagcttttgcggtgtgggatgggcccgcggcctatcagctagttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttctaa

SEQ ID NO: 5868 - DNA, 1538 bp, Mycobacterium persicum
  ref <308>: DATABASE ACCESSION NUMBER: NCBI ACCESSION: NZ_UPHM01000100.1
  ref <309>: DATABASE ENTRY DATE: 2019-04-01
  ref <313>: RELEVANT RESIDUES IN SEQ ID NO: (1)..(1538)
ttgtttggagagtttgatcctggctcaggacgaacgctggcggcgtgcttaacacatgcaagtcgaacggaaaggcccttcggggtactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttgtctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaaggag

SEQ ID NO: 5869 - DNA, 1540 bp, Mycobacterium pseudoshottsii
  ref <308>: DATABASE ACCESSION NUMBER: NCBI ACCESSION: NZ_AP018410.1
  ref <309>: DATABASE ENTRY DATE: 2019-04-01
  ref <313>: RELEVANT RESIDUES IN SEQ ID NO: (1)..(1540)
ttgtttggagagtttgatcctggctcaggacgaacgctggcggcgtgcttaacacatgcaagtcgaacggaaaggtctcttcggagacactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtagatggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcgacgcgaagaaccttacctgggtttgacatgcacaggactcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgcccagggcttcacacatgctacaatggccggtacaaagggctgcgatgccgcgaggttaagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaaggag

SEQ ID NO: 5870 - DNA, 1524 bp, Mycobacterium shigaense
  ref <308>: DATABASE ACCESSION NUMBER: NCBI ACCESSION: NZ_CP022927.1
  ref <309>: DATABASE ENTRY DATE: 2019-04-01
  ref <313>: RELEVANT RESIDUES IN SEQ ID NO: (1)..(1524)
ttgtttggagagtttgatcctggctcaggacgaacgctggcggcgtgcttaacacatgcaagtcgaacggaaaggccccttcgggggtactcgagtggcgaacgggtgagtaacacgtgggtaatctgccctgcacttcgggataagcctgggaaactgggtctaataccggataggaccacttagcgcatgctttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgcgtaatggcggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctcctttctaa

SEQ ID NO: 5871 - DNA, 1525 bp, Mycobacterium sp. 4858
  ref <308>: DATABASE ACCESSION NUMBER: NCBI ACCESSION: NZ_LT968775.1
  ref <309>: DATABASE ENTRY DATE: 2019-04-01
  ref <313>: RELEVANT RESIDUES IN SEQ ID NO: (1)..(1525)
ttgtttggagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggaccacttggcgcatgccttgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaa

SEQ ID NO: 5872 - DNA, 1524 bp, Mycobacterium sp. AB215
  ref <308>: DATABASE ACCESSION NUMBER: NCBI ACCESSION: NZ_FUEZ01000004.1
  ref <309>: DATABASE ENTRY DATE: 2019-04-01
  ref <313>: RELEVANT RESIDUES IN SEQ ID NO: (1)..(1524)
ttgtttggagagtttgatcctggctcaggacgaacgctggcggcgtgcttaacacatgcaagtcgaacggaaaggcctcttcggaggtactcgagtggcgaacgggtgagtaacacgtgggtaatctgccctgcacttcgggataagcctgggaaactgggtctaataccgaataggaccatttagcgcatgctttatggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctcctttctaa

SEQ ID NO: 5873 - DNA, 1525 bp, Mycobacterium sp. AB308
  ref <308>: DATABASE ACCESSION NUMBER: NCBI ACCESSION: NZ_LT717701.1
  ref <309>: DATABASE ENTRY DATE: 2019-04-01
  ref <313>: RELEVANT RESIDUES IN SEQ ID NO: (1)..(1525)
ttgtttggagagtttgatcctggctcaggacgaacgctggcggcgtgcttaacacatgcaagtcgaacggaaaggccccttcgggggtactcgagtggcgaacgggtgagtaacacgtgggtaatctgccctgcacttcgggataagcctgggaaactgggtctaataccggataggacctcgaggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttctaa

SEQ ID NO: 5874 - DNA, 1530 bp, Mycobacterium sp. CECT 8778
  ref <308>: DATABASE ACCESSION NUMBER: NCBI ACCESSION: NZ_NVQE01000090.1
  ref <309>: DATABASE ENTRY DATE: 2019-04-01
  ref <313>: RELEVANT RESIDUES IN SEQ ID NO: (1)..(1530)
gtttttgtttggagagtttgattctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccggatatacctcatggactgcatggtttgtgggggaaagcttttgcggtgtgggatgggcccgcggcctatcagcttgttggtgaggttatggcttaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgtagaagaaggaccggccaactacgtgccagcagccgcggtaatacgtagggtccgagcgttgtccggaattactgggcgtaaagagctcgtaggtggtttgtcgcgttgttcgtgaaaactcacagctcaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgtgcctagagataggtattcccttgtggcctgtgtgcaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5875 - DNA, 1523 bp, Mycobacterium sp. DL90
  ref <308>: DATABASE ACCESSION NUMBER: NCBI ACCESSION: NZ_CP034072.1
  ref <309>: DATABASE ENTRY DATE: 2019-04-01
  ref <313>: RELEVANT RESIDUES IN SEQ ID NO: (1)..(1523)
ttgtttggagagtttgattctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaatatgaccgcgcacttcctggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcaatagggacgaagcgcaagtgacggtacctatagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccagtagagatattggttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 5876 - DNA, 1546 bp, Mycobacterium sp. MFM001
  ref <308>: DATABASE ACCESSION NUMBER: NCBI ACCESSION: NZ_BFAB01000017.1
  ref <309>: DATABASE ENTRY DATE: 2019-04-01
  ref <313>: RELEVANT RESIDUES IN SEQ ID NO: (1)..(1546)
ttgtttggagagtttgatcctggctcaggacgaacgctggcggcgtgcttaacacatgcaagtcgaacggaaaggcccctttcggggggtgctcgagtggcgaacgggtgagtaacacgtgggtgatctgccctgcacttcgggataagcttgggaaactgggtctaataccggataggactccgagatgcatgtcttggggtggaaagcttttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgccgctttttgtggtggtgacggtaggtggagaagaagcaccggccaactacgtgccagcagccgcggtaatacgtagggtgcgagcgttgtccggaattactgggcgtaaagagctcgtaggtggtttgtcgcgttgttcgtgaaattccctggcttaactgggggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcatccagagatgggtgttcccttgtggcctgtgtgcaggtggtgcatggctgtcgtcagctcgtgtcgtgagatgttgggttaagtcccgcaacgagcgcaacccttgtctcatgttgccagcgcgtgatggcggggactcgtgagagactgccggggtcaactcggaggaaggtggggatgacgtcaagtcatcatgccccttatgtccagggcttcacacatgctacaatggccggtacaaagggctgcgatgccgtgaggtttagcgaatcctttaaagccggtctcagttcggatcggggtctgcaactcgaccccgtgaagtcggagtcgctagtaatcgcagatcagcaatgctgcggtgaatacgttcccgggccttgtacacaccgcccgtcacgtcatgaaagtcggtaacacccgaagcccatggcctaacccgcaagggagggagtggtcgaaggtgggatcggcgattgggacgaagtcgtaacaaggtagccgtaccggaaggtgcggctggatcacctcctttctaaggag

SEQ ID NO: 5877 - DNA, 1540 bp, Mycobacterium sp. MK13
  ref <308>: DATABASE ACCESSION NUMBER: NCBI ACCESSION: NZ_UPHQ01000197.1
  ref <309>: DATABASE ENTRY DATE: 2019-04-01
  ref <313>: RELEVANT RESIDUES IN SEQ ID NO: (1)..(1540)
ttgtttggagagtttgatcctggctcaggacgaacgctggcggcgtgcttaacacatgcaagtcgaacggaaaggtctcttcggagacactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgatggcccaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaaggag

SEQ ID NO: 5878 - DNA, 1538 bp, Mycobacterium sp. MK136
  ref <308>: DATABASE ACCESSION NUMBER: NCBI ACCESSION: NZ_UPHP01000106.1
  ref <309>: DATABASE ENTRY DATE: 2019-04-01
  ref <313>: RELEVANT RESIDUES IN SEQ ID NO: (1)..(1538)
ttgtttggagagtttgatcctggctcaggacgaacgctggcggcgtgcttaacacatgcaagtcgaacggaaaggcccttcggggtactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttctaaggag

SEQ ID NO: 5879 - DNA, 1538 bp, Mycobacterium sp. MK142
  ref <308>: DATABASE ACCESSION NUMBER: NCBI ACCESSION: NZ_UPHU01000001.1
  ref <309>: DATABASE ENTRY DATE: 2019-04-01
  ref <313>: RELEVANT RESIDUES IN SEQ ID NO: (1)..(1538)
ttgtttggagagtttgatcctggctcaggacgaacgctggcggcgtgcttaacacatgcaagtcgaacggaaaggcccttcggggtactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaaggag

SEQ ID NO: 5880 - DNA, 1538 bp, Mycobacterium sp. MK191
  ref <308>: DATABASE ACCESSION NUMBER: NCBI ACCESSION: NZ_UPHS01000114.1
  ref <309>: DATABASE ENTRY DATE: 2019-04-01
  ref <313>: RELEVANT RESIDUES IN SEQ ID NO: (1)..(1538)
ttgtttggagagtttgatcctggctcaggacgaacgctggcggcgtgcttaacacatgcaagtcgaacggaaaggcccttcggggtactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggtttcctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttctaaggag

SEQ ID NO: 5881 - DNA, 1538 bp, Mycobacterium sp. MK21; identical to SEQ ID NO: 5879
  ref <308>: DATABASE ACCESSION NUMBER: NCBI ACCESSION: NZ_UPHO01000126.1
  ref <309>: DATABASE ENTRY DATE: 2019-04-01
  ref <313>: RELEVANT RESIDUES IN SEQ ID NO: (1)..(1538)

SEQ ID NO: 5882 - DNA, 1538 bp, Mycobacterium sp. MK35; identical to SEQ ID NO: 5879
  ref <308>: DATABASE ACCESSION NUMBER: NCBI ACCESSION: NZ_UPHN01000121.1
  ref <309>: DATABASE ENTRY DATE: 2019-04-01
  ref <313>: RELEVANT RESIDUES IN SEQ ID NO: (1)..(1538)

SEQ ID NO: 5883 - DNA, 1538 bp, Mycobacterium sp. MK41
  ref <308>: DATABASE ACCESSION NUMBER: NCBI ACCESSION: NZ_UPHT01000123.1
  ref <309>: DATABASE ENTRY DATE: 2019-04-01
  ref <313>: RELEVANT RESIDUES IN SEQ ID NO: (1)..(1538)
ttgtttggagagtttgatcctggctcaggacgaacgctggcggcgtgcttaacacatgcaagtcgaacggaaaggcccttcggggtactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttctaaggag

SEQ ID NO: 5884 - DNA, 1464 bp, Mycobacterium sp. P7213
  ref <308>: DATABASE ACCESSION NUMBER: NCBI ACCESSION: NZ_UWOA01000093.1
  ref <309>: DATABASE ENTRY DATE: 2019-04-01
  ref <313>: RELEVANT RESIDUES IN SEQ ID NO: (1)..(1464)
ttcgttcgggggtactcgagtggcgaacgggtgagtaacacgtgggtgatctgccctgcactttgggataagcctgggaaactgggtctaataccgaataggaccacgcgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccaggattcttcttggggtgacggtaggtacagaagaagcaccggccaactacgtgccagcagccgcggtaatacgtagggtgcgagcgttgtccggaattactgggcgtaaagagctcgtaggtggtttgtcacgttgtccgtgaaaactcacagcttaactgtgggcgtgcgggcgatacgggcagactggagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttcta

SEQ ID NO: 5885 - DNA, 1527 bp, Mycobacterium sp. PYR15
  ref <308>: DATABASE ACCESSION NUMBER: NCBI ACCESSION: NZ_CP023435.1
  ref <309>: DATABASE ENTRY DATE: 2019-04-01
  ref <313>: RELEVANT RESIDUES IN SEQ ID NO: (1)..(1527)
ttgtttggagagtttgatcctggctcaggacgaacgctggcggcgtgcttaacacatgcaagtcgaacggaaagtgctcttcggagtgactcgagtggcgaacgggtgagtaacacgtgggtgatctgccctgcactttgggataagcctgggaaactgggtctaataccggataggaccacggccttcatgggttgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgcaagtgacggtacctgtagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5886 - DNA, 1533 bp, Mycobacterium sp. UNC267MFSha1.1M11
  ref <308>: DATABASE ACCESSION NUMBER: NCBI ACCESSION: NZ_FMUB01000001.1
  ref <309>: DATABASE ENTRY DATE: 2019-04-01
  ref <313>: RELEVANT RESIDUES IN SEQ ID NO: (1)..(1533)
gtgggggtttttgtttggagagtttgattctggctcaggacgaacgctggcggcgtgcttaacacatgcaagtcgaacggaaaggcccttcggggtgctcgagtggcgaacgggtgagtaacacgtgggtgatctgccctgcactttgggataagcctgggaaactgggtctaataccgaatatgaccgcattcttcatggggtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccagtagagatattggttcccttgtggcctgtgtgcaggtggtgcatggctgtcgtcagctcgtgtcgtgagatgttgggttaagtcccgcaacgagcgcaacccttgtcctatgttgccagcgggttatgccggggactcgtaggagactgccggggtcaactcggaggaaggtggggatgacgtcaagtcatcatgccccttatgtccagggcttcacacatgctacaatggccggtacaaagggctgcgatgccgtgaggtggagcgaatccttgtaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 5887 - DNA, 1523 bp, Mycobacterium syngnathidarum
  ref <308>: DATABASE ACCESSION NUMBER: NCBI ACCESSION: NZ_MLCL01000005.1
  ref <309>: DATABASE ENTRY DATE: 2019-04-01
  ref <313>: RELEVANT RESIDUES IN SEQ ID NO: (1)..(1523)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaataggaccacgcatttcatggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcaatagggacgaagcgcaagtgacggtacctatagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatattggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 5888 - DNA, 1543 bp, Mycobacterium ulcerans
  ref <308>: DATABASE ACCESSION NUMBER: NCBI ACCESSION: NZ_LR135168.1
  ref <309>: DATABASE ENTRY DATE: 2019-04-01
  ref <313>: RELEVANT RESIDUES IN SEQ ID NO: (1)..(1543)
ttgtttggagagtttgatcctggctcaggacgaacgctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtgcaaagggctgcgatgccgcgaggttaagcgaatcctttaacgccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttttttgggagggagctgtcgaaggtgggatcggcgattgggacgaagtcgtaacaaggtagccgtaccggaaggtgcggctggatcacctcctttctaaggag

SEQ ID NO: 5889 - DNA, 1528 bp, Mycobacteroides chelonae
  ref <308>: DATABASE ACCESSION NUMBER: NCBI ACCESSION: NZ_LR134345.1
  ref <309>: DATABASE ENTRY DATE: 2019-04-01
  ref <313>: RELEVANT RESIDUES IN SEQ ID NO: (1)..(1528)
ttgtttggagagtttgatcctggctcaggacgaacgctggcggcgtgcttaacacatgcaagtcgaacggaaaggccccttcgggggtactcgagtggcgaacgggtgagtaacacgtgggtgatctgccctgcactctgggataagcctgggaaactgggtctaataccggatacacccttctggttgcatggctgggaggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtagggacgaagcgtgagtgacggtacctacagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgacggcagagatgtcgtttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagaccgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5890 - DNA, 1544 bp, Mycolicibacter engbaekii
  ref <308>: DATABASE ACCESSION NUMBER: NCBI ACCESSION: NZ_LQOT01000050.1
  ref <309>: DATABASE ENTRY DATE: 2019-04-01
  ref <313>: RELEVANT RESIDUES IN SEQ ID NO: (1)..(1544)
ttgtttggagagtttgatcctggctcaggacgaacgctggcggcgtgcttaacacatgcaagtcgaacggaaaggccccttcgggggtactcgagtggcgaacgggtgagtaacacgtgggtgatctgccctgcactctgggataagcctgggaaactgggtctaataccggataggaccgcgcgcttcatggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccgtggttttctgcggggtgacggtaggtacagaagaagcaccggccaactacgtgccagcagccgcggtaatacgtagggtgcgagcgttgtccggaattactgggcgtaaagagctcgtaggtggtttgtcacgttgttcgtgaaaactcacagcttaactgtgggcgtgcgggcgatacgggcagactagagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaaggag

SEQ ID NO: 5891 - DNA, 1544 bp, Mycolicibacter hiberniae
  ref <308>: DATABASE ACCESSION NUMBER: NCBI ACCESSION: NZ_LQOZ01000008.1
  ref <309>: DATABASE ENTRY DATE: 2019-04-01
  ref <313>: RELEVANT RESIDUES IN SEQ ID NO: (1)..(1544)
ttgtttggagagtttgatcctggctcaggacgaacgctggcggcgtgcttaacacatgcaagtcgaacggaaaggccccttcgggggtactcgagtggcgaacgggtgagtaacacgtgggtgatctgccctgcactctgggataagcctgggaaactgggtctaataccggataggaccgcgcgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccgtggttttctgcggggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactagagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaaggag

SEQ ID NO: 5892 - DNA, 1525 bp, Mycolicibacterium aromaticivorans
  ref <308>: DATABASE ACCESSION NUMBER: NCBI ACCESSION: NZ_JALN02000001.1
  ref <309>: DATABASE ENTRY DATE: 2019-04-01
  ref <313>: RELEVANT RESIDUES IN SEQ ID NO: (1)..(1525)
ttgtttggagagtttgattctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaatatgatcatggcctgcatgggttgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgcaagtgacggtacctatagaagaaggaccggccaactacgtgccagcagccgcggtaatacgtagggtccgagcgttgtccggaattactgggcgtaaagagctcgtaggtggtttgtcgcgttgttcgtgaaaactcacagctcaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5893 - DNA, 1525 bp, Mycolicibacterium aurum
  ref <308>: DATABASE ACCESSION NUMBER: NCBI ACCESSION: NZ_LR134356.1
  ref <309>: DATABASE ENTRY DATE: 2019-04-01
  ref <313>: RELEVANT RESIDUES IN SEQ ID NO: (1)..(1525)
ttgtttggagagtttgattctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaataggactacgcgatgcatgtcgtgtggtggaaagcttttgcggtgtgggatgggcccgcggcctatcagcttgttggtgaggttacggctcaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggagaagaaggaccggccaactacgtgccagcagccgcggtaatacgtagggtccgagcgttgtccggaattactgggcgtaaagagctcgtaggtggtttgtcgcgttgttcgtgaaaactcacagctcaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgtgcctagagataggtattcccttgtggcctgtgtgcaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5894 - DNA, 1524 bp, Mycolicibacterium chitae
  ref <308>: DATABASE ACCESSION NUMBER: NCBI ACCESSION: NZ_LR134355.1
  ref <309>: DATABASE ENTRY DATE: 2019-04-01
  ref <313>: RELEVANT RESIDUES IN SEQ ID NO: (1)..(1524)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaatatgatcatggccttcatgggttgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgggggatgacggccttcgggttgtaaacctctttcagtcacgacgaagcgcaagtgacggtagtgacagaagaagcaccggccaactacgtgccagcagccgcggtaatacgtagggtgcgagcgttgtccggaattactgggcgtaaagagctcgtaggtggtttgtcgcgttgtccgtgaaaactcacaactcaattgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccgtaagggagggagctgtcgaaggtgggatcggcgattgggacgaagtcgtaacaaggtagccgtaccggaaggtgcggctggatcacctcctttctaa

SEQ ID NO: 5895 - DNA, 1525 bp, Mycolicibacterium cosmeticum
  ref <308>: DATABASE ACCESSION NUMBER: NCBI ACCESSION: NZ_CCBB010000001.1
  ref <309>: DATABASE ENTRY DATE: 2019-04-01
  ref <313>: RELEVANT RESIDUES IN SEQ ID NO: (1)..(1525)
ttgtttggagagtttgatcctggctcaggacgaacgctggcggcgtgcttaacacatgcaagtcgaacggaaaggcccttcggggtgctcgagtggcgaacgggtgagtaacacgtgggtgatctgccctgcactttgggataagcctgggaaactgggtctaataccgaataggactccggccttcatgggttggggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtcctatgttgccagcgggttatgccggggactcgtaggagactgccggggtcaactcggaggaaggtggggatgacgtcaagtcatcatgccccttatgtccagggcttcacacatgctacaatggccggtacaaagggctgcgatgccgtgaggtggagcgaatccttgtaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5896 - DNA, 1528 bp, Mycolicibacterium elephantis
  ref <308>: DATABASE ACCESSION NUMBER: NCBI ACCESSION: NZ_ATDN01000055.1
  ref <309>: DATABASE ENTRY DATE: 2019-04-01
  ref <313>: RELEVANT RESIDUES IN SEQ ID NO: (1)..(1528)
ttgtttggagagtttgatcctggctcaggacgaacgctggcggcgtgcttaacacatgcaagtcgaacggaaaggcccctttgggggtgctcgagtggcgaacgggtgagtaacacgtgggtgatctgccctgcactttgggataagcctgggaaactgggtctaataccgaatacaccctgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtaccgacgaagcgtaagtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtcatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgcaagggagggagccgtcgaaggtgggatcggcgattgggacgaagtcgtaacaaggtagccgtaccggaaggtgcggctggatcacctcctttctaa

SEQ ID NO: 5897 - DNA, 1523 bp, Mycolicibacterium farcinogenes
  ref <308>: DATABASE ACCESSION NUMBER: NCBI ACCESSION: NZ_HG964483.1
  ref <309>: DATABASE ENTRY DATE: 2019-04-01
  ref <313>: RELEVANT RESIDUES IN SEQ ID NO: (1)..(1523)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccggataggaccacgcgcttcatggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcaatagggacgaagcgcaagtgacggtacctatagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccagtagcgatattggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 5898 - DNA, 1529 bp, Mycolicibacterium flavescens
  ref <308>: DATABASE ACCESSION NUMBER: NCBI ACCESSION: NZ_LR134353.1
  ref <309>: DATABASE ENTRY DATE: 2019-04-01
  ref <313>: RELEVANT RESIDUES IN SEQ ID NO: (1)..(1529)
ttgtttggagagtttgattctggctcaggacgaacgctggcggcgtgcttaacacatgcaagtcgaacggaaaggcccctttgggggtgctcgagtggcgaacgggtgagtaacacgtgggtgatctgccctgcactttgggataagcctgggaaactgggtctaataccgaatacaccttgctggtcgcatggcctggtgggggaaagcttttgcggtgtgggatgggcccgcggcctatcagcttgttggtgaggttatggcttaccaaggcgacgacgggtagccggcctgagagggtgaccggccacactgggactgagatacggcccagactcctacgggaggcagcagtggggaatattgcacaatgggcgcaagcctgatgcagcgacgccgcgtgggggatgacggccttcgggttgtaaacctctttcagtgccgacgaagcgtaagtgacggtaggcacagaagaaggaccggccaactacgtgccagcagccgcggtaatacgtagggtccgagcgttgtccggaattactgggcgtaaagagctcgtaggtggtttgtcgcgttgtccgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgactgcagagatgtggtttcccttgtggcctgtgtgcaggtggtgcatggctgtcgtcagctcgtgtcgtgagatgttgggttaagtcccgcaacgagcgcaacccttgtctcatgttgccagcgcgttatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5899 - DNA, 1530 bp, Mycolicibacterium hassiacum
  ref <308>: DATABASE ACCESSION NUMBER: NCBI ACCESSION: NZ_LR026975.1
  ref <309>: DATABASE ENTRY DATE: 2019-04-01
  ref <313>: RELEVANT RESIDUES IN SEQ ID NO: (1)..(1530)
ttgtttggagagtttgatcctggctcaggacgaacgctggcggcgtgcttaacacatgcaagtcgaacggaaaggccccttcgggggtactcgagtggcgaacgggtgagtaacacgtgggtgacctgccctgcactctgggataagcctgggaaactgggtctaataccggatattcccttctggccgcatggttggttggggaaagcgttatgtagcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcgccgacgaagcgtaagtgacggtaggcgcagaagaagcaccggccaactacgtgccagcagccgcggtaatacgtagggtgcgagcgttgtccggaattactgggcgtaaagagctcgtaggtggtttgtcgcgttgtccgtgaaatcccacggcttaactgtgggcgtgcgggcgatacgggcagactagagtgctgcaggggagactggaattcctggtgtagcggtggaatgcgcagatatcaggaggaacaccggtggcgaaggcgggtctctgggcagctactgacgctgaggagcgaaagcgtggggagcgaacaggattagataccctggtagtccacgccgtaaacggtgggtactaggtgtgggttctttcctaaggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttccctttgggcctgtgtgcaggtggtgcatggctgtcgtcagctcgtgtcgtgagatgttgggttaagtcccgcaacgagcgcaacccttgtcccatgttgccagcgggtgatgccggggactcatgggagactgccggggtcaactcggaggaaggtggggatgacgtcaagtcatcatgccccttatgtccagggcttcacacatgctacaatggccggtacaaagggctgcgaagccgtgaggtggagcgaatccctgcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgtcagggagggagccgtcgaaggtgggatcggcgattgggacgaagtcgtaacaaggtagccgtaccggaaggtgcggctggatcacctcctttctaa

SEQ ID NO: 5900 - DNA, 1529 bp, Mycolicibacterium komanii
  ref <308>: DATABASE ACCESSION NUMBER: NCBI ACCESSION: NZ_CVTA01000034.1
  ref <309>: DATABASE ENTRY DATE: 2019-04-01
  ref <313>: RELEVANT RESIDUES IN SEQ ID NO: (1)..(1529)
ttgtttggagagtttgatcctggctcaggacgaacgctggcggcgtgcttaacacatgcaagtcgaacggaaaggccctttcgggggtactcgagtggcgaacgggtgagtaacacgtgggtgatctgccctgcactttgggataagcctgggaaactgggtctaataccgaatattccctgctggccgcatggtctggtgggggaaagcttttgcggtgtgggatgagcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtaccgacgaagcgcaagtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacggcggcagagatgtcgtttcccttgtggcctgtgtgcaggtggtgcatggctgtcgtcagctcgtgtcgtgagatgttgggttaagtcccgcaacgagcgcaacccttgtctcatgttgccagcgcgttatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5901 - DNA, 1530 bp, Mycolicibacterium mucogenicum
  ref <308>: DATABASE ACCESSION NUMBER: NCBI ACCESSION: NZ_RBIK01000001.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggaagagtggcgaacgggtgagtaacacgtgagtaacctgccctgaactctgggataagcactggaaacggtgtctaatactggatacgacctatcaccgcatggtgtgtgggtggaaagatttatcggttttggatggactcgcggcctatcagctagatggtgaggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggcttgtcgcgtctgctgtgaaatcccggggctcaaccccgggcctgcagtgggtacgggcaagctagagtgcggtaggggagattggaattcctggtgtagcggtggaatgcgcagatatcaggaggaacaccgatggcgaaggcagatctctgggccgctactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatagccgagaacgctgtagagatacagaactctttggacactcggttacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccgatacaaagggctgcgataccgcgaggtggagcgaatcccaaaaagtcggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccctgtggagggagccgtcgaaggtgggactggtgattaggactaagtcgtaacaaggtagccgtaccggaaggtgcggctggatcacctcctttctaagga

SEQ ID NO: 5902 - DNA, 1524 bp, Mycolicibacterium neoaurum
  ref <308>: DATABASE ACCESSION NUMBER: NCBI ACCESSION: NZ_CP031414.1
  ref <309>: DATABASE ENTRY DATE: 2019-04-01
  ref <313>: RELEVANT RESIDUES IN SEQ ID NO: (1)..(1524)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaatatgatcatcggcttcatggtcggtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacggggggccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtcctatgttgccagcgggttatgccggggactcgtaggagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattggacgaagtcgtaacaaggtagccgtaccggaaggtgcggctggatcacctcctttctaa

SEQ ID NO: 5903 - DNA, 1523 bp, Mycolicibacterium peregrinum
  ref <308>: DATABASE ACCESSION NUMBER: NCBI ACCESSION: NZ_NCSV01000068.1
  ref <309>: DATABASE ENTRY DATE: 2019-04-01
  ref <313>: RELEVANT RESIDUES IN SEQ ID NO: (1)..(1523)
ttgtttggagagtttgattctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaatatgaccgcgcacttcctggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcaatagggacgaagcgcaagtgacggtacctatagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccagtagagatattggttcccttgtggcctgtgtgcaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 5904 - DNA, 1521 bp, Mycolicibacterium phlei
  ref <308>: DATABASE ACCESSION NUMBER: NCBI ACCESSION: NZ_LR134347.1
  ref <309>: DATABASE ENTRY DATE: 2019-04-01
  ref <313>: RELEVANT RESIDUES IN SEQ ID NO: (1)..(1521)
ttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactctgggataagcctgggaaactgggtctaataccggataggaccacacacttcatggtgagtggtgcaaagcttttgcggtgtgggatgagcccgcggcctatcagcttgttggtggggtaatggcccaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgaaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcgcaggacgtatctagagataggtattcccttgtggcctgcgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgcaaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctcctttctaa

SEQ ID NO: 5905 - DNA, 1529 bp, Mycolicibacterium sp. CECT 8783
  ref <308>: DATABASE ACCESSION NUMBER: NCBI ACCESSION: NZ_RARC01000066.1
  ref <309>: DATABASE ENTRY DATE: 2019-04-01
  ref <313>: RELEVANT RESIDUES IN SEQ ID NO: (1)..(1529)
ttgtttggagagtttgattctggctcaggacgaacgctggcggcgtgcttaacacatgcaagtcgaacggtaaggccctttcgggggtacacgagtggcgaacgggtgagtaacacgtgggtgatctgccctgcactttgggataagcctgggaaactgggtctaataccgaatattccttgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgagggatgacggccttcgggttgtaaacctctttcagtacagacgaagcgtgagtgacggtatgtacagaagaagcaccggccaactacgtgccagcagccgcggtaatacgtagggtgcgagcgttgtccggaattactgggcgtaaagagctcgtaggtggtttgtcgcgttgttcgtgaaaacctaaggcttaaccttgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatccttgttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttggggagggagccgtcgaaggtgggatcggcgattgggacgaagtcgtaacaaggtagccgtaccggaaggtgcggctggatcacctcctttctaa

SEQ ID NO: 5906 - DNA, 1527 bp, Mycolicibacterium tusciae
  ref <308>: DATABASE ACCESSION NUMBER: NCBI ACCESSION: NZ_MVIM01000048.1
  ref <309>: DATABASE ENTRY DATE: 2019-04-01
  ref <313>: RELEVANT RESIDUES IN SEQ ID NO: (1)..(1527)
ttgtttggagagtttgattctggctcaggacgaacgctggcggcgtgcttaacacatgcaagtcgaacggaaaggccctttcgggggtactcgagtggcgaacgggtgagtaacacgtgggtgatctgccctgcactttgggataagcctgggaaactgggtctaataccggatatacctcatgggctgcatggtttgtgagggaaagcttttgcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgtagaagaaggaccggccaactacgtgccagcagccgcggtaatacgtagggtccgagcgttgtccggaattactgggcgtaaagagctcgtaggtggtttgtcgcgttgttcgtgaaaactcacagctcaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttcttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtctcatgttgccagcacgtcatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 5907 - DNA, 1491 bp, Mycoplana dimorpha
  ref <308>: DATABASE ACCESSION NUMBER: NCBI ACCESSION: NZ_PZZZ01000020.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgagcgccccgcaaggggagcggcagacgggtgagtaacgcgtgggaacctacccttttctgcggaataacccagggaaacttggactaataccgcatacgcccttcgggggaaagatttatcggagaaggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtgtggaagaggtgagtggaattccgagtgtagaggtgaaattcgtagatattcggaggaacaccagtggcgaaggcggctcactggtccactactgacgctgaggtgcgaaagcgtggggagcaaacaggattagataccctggtagtccacgccgtaaacgatgaatgttagccgtcggcaagcttgcttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagagatggtttccttcagttcggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgccaaccgcaaggaggcaggcgaccacggtagggtcagcgactggggtgaagtcgtaacaaggtagccgtaggggaacctgcggctggatcacctcctttctaag

SEQ ID NO: 5908 - DNA, 1529 bp, Mycoplasma alkalescens
  ref <308>: DATABASE ACCESSION NUMBER: NCBI ACCESSION: NZ_LS991949.1
  ref <309>: DATABASE ENTRY DATE: 2019-04-01
  ref <313>: RELEVANT RESIDUES IN SEQ ID NO: (1)..(1529)
aatttttaagagtttgatcctggctcaggatgaacgctggctgtgtgcctaatacatgcatgtcgagcgaggttttttaaacctagcggcgaatgggtgagtaacacgtgcttaatctaccctttagattggaatacccaatggaaacattggctaatgccggatacgcataaaatcgcatgattttgttgtgaaaggagcctttaaagctccactagaggatgagggtgcggaacattagttagttggtagggtaatggcctaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttatagggaaagaaaacttggttgaggaaatgcttccaagctgacggtaccctgtcagaaagcgatggctaactatgtgccagcagccgcggtaatacataggtcgcaagcgttatccggaattattgggcgtaaagcgtttgtaggctgtttattaagtctggagttaaatcccagggctcaaccctggttcgctttggatactggtaaactagagttggatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggagaattcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtcgaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctacgctgcggtgaatacgttctcgggtcttgtacacaccgcccgtcacaccatgggagctggtaatacccgaagtcggttagctaacctcggaggcgaccgcctaaggtaggactggtgactggggtgaagtcgtaacaaggtatccctacgagaacgtggggatggatcacctcctttcaacgga

SEQ ID NO: 5909 - DNA, 1524 bp, Mycoplasma anatis
  ref <308>: DATABASE ACCESSION NUMBER: NCBI ACCESSION: NZ_LR215035.1
  ref <309>: DATABASE ENTRY DATE: 2019-04-01
  ref <313>: RELEVANT RESIDUES IN SEQ ID NO: (1)..(1524)
acatgacagtcaattttttcgagagtttgatcctggctcaggatgaacgctggctgtgtgcctaatacatgcatgtcgagcggagttcttcggaacttagcggcgaatgggtgagtaacacgtacttaacataccctttagattggaataacgattagaaatgatcgctaatgccggatacttatatttatcgcatgaaaaatatataaaaggagcgtttgcttcgctagaggattggggtgcgtaacattagctagttggtagggtaatggcctaccaaggctatgatgtttagcggggttgagagactgatccgccacactgggactgagatacggcccagactcctacgggaggcagcagtagggaattttccacaatggacgaaagtctgatggagcgacacagcgtgcaggatgacggccttcgggttgtaaactgctgttataagggaagaaaaaataaagtaggaaatgactttatcttgacggtaccttgtcagaaagcaacggctaactatgtgccagcagccgcggtaatacataggttgcaagcgttatccggaattattgggcgtaaagcgtctgtaggttgtttgttaagtctgacgtgaaaacttggggctcaaccccaaattgcgttggatactggcgaactagagttatgaagaggttagcggaattccttgtgaagcggtgaaatgcgtagatataaggaagaacaccaatttggcgaaggcagctaactgggcatacactgacactgagagacgaaagcgtggggagcaaacaggattagataccctggtagtccacgctgtaaacgatgatgattagctgatggggaactcatcggcacagctaacgcattaaatcatccgcctgagtagtatgctcgcaagagtgaaacttaaaggaattgacggggatccgcacaagcggtggagcatgtggtttaatttgattctacgcgtagaaccttacccactcttgacatcttccgcaaagctatagagatatagtggaggtcaacggaatgacagatggtgcatggttgtcgtcagctcgtgtcgtgagatgttcggttaagtcctgcaacgagcgcaacccttgtccttagttaaatgttctaaggagactgcccgagtaattgggaggaaggtggggacgacgtcaaatcatcatgcctcttacgagtggggcaacacacgtgctacaatggacggtacaaagagacgcaatacggcgacgtggagcaaatctcaaaaaaccgttctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcaggactggtgactggggtgaagtcgtaacaaggtatccctacgagaacgtggggatggattacctcctttcta

SEQ ID NO: 5910 - DNA, 1525 bp, Mycoplasma arginini
  ref <308>: DATABASE ACCESSION NUMBER: NCBI ACCESSION: NZ_LR215044.1
  ref <309>: DATABASE ENTRY DATE: 2019-04-01
  ref <313>: RELEVANT RESIDUES IN SEQ ID NO: (1)..(1525)
aaattttaagagtttgatcctggctcaggatgaacgctggctgtgtgcctaatacatgcatgtcgagcgaggttcttttgaacctagcggcgaatgggtgagtaacacgtgcttaatctaccctttagattggaatacccaatggaaacattggctaatgccggatacgcatggaatcgcatgattccgttgtgaaaggagcctttaaagctccgctagaggatgagggtgcggaacattagttagttggtagggtaatggcctaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttatagggaaagaacacctggttgaggaaatgcttccaggctgacggtaccctgtcagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttagatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggagagttcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaatgctatagagatatagcggaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctacgctgcggtgaatacgttttcgggtcttgtacacaccgcccgtcacaccatgggagctggtaatacccaaagtcggttagctaacctcggaggcgaccgcctaaggtaggactggtgactggggtgaagtcgtaacaaggtatccctacgagaacgtggggatggatcacctcctttca

SEQ ID NO: 5911 - DNA, 1524 bp, Mycoplasma arthritidis
  ref <308>: DATABASE ACCESSION NUMBER: NCBI ACCESSION: NZ_LR215047.1
  ref <309>: DATABASE ENTRY DATE: 2019-04-01
  ref <313>: RELEVANT RESIDUES IN SEQ ID NO: (1)..(1524)
atttttaagagtttgatcctggctcaggatgaacgctggctgtgtgcctaatacatgcatgtcgagcggaagtagcaatactttagcggcgaatgggtgagtaacacgtgcttaatctaccctttagactggaataactaatggaaacattggctaatgccggatgcgcatggaatcgcatgattccgttgtgaaaggagcctcaaagctccactagaggatgagggtgcggaacattagcttgttggtgaggtaacggcccaccaaggcaatgatgtttagccgggtcgagagactgaacggccacattgggactgagatacggcccaaactcctacgggaggcagcagtagggaatattccacaatgagcgaaagcttgatggagcgacacagcgtgcacgatgacggtcttcggattgtaaagtgctgttataggggaagaacacttagttgaggaaatgcttctaagctgacggtaccctgtcagaaagcgatggctaactatgtgccagcagccgcggtaatacataggtcgcaagcgttatccggaattattgggcgtaaagcgttcgtaggctgtttattaagtctggagttaaatcccagggctcaaccctggctcgctttggatactggtaaactagagttagatagaggtaagcggaattccatgtgaagcggtgaaatgcgtagatatatggaagaacaccaaaggcgaaggcagcttgctgggtctatactgacgctgagggacgaaagcgtggggagcaaacaggattagataccctggtagtccacgccgtaaacgatgatcattagtcggtggattaatcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtggaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtggggatggatcacctcctttcta

SEQ ID NO: 5912 - DNA, 1546 bp, Mycoplasma bovigenitalium
  ref <308>: DATABASE ACCESSION NUMBER: NCBI ACCESSION: NZ_LR214970.1
  ref <309>: DATABASE ENTRY DATE: 2019-04-01
  ref <313>: RELEVANT RESIDUES IN SEQ ID NO: (1)..(1546)
ctagatatataaacatgacgaagtcaattttttcgagagtttgatcctggctcaggatgaacgctggctgtgtgcctaatacatgcatgtcgagcgaagtgatttatcacttagcggcgaatgggtgagtaacacgtactcaacgtacccttcagtttggcatagcggttggaaacaaccgataattccaaatactcgtagatgccgcatggcatttacggaaaagacgccttaaagcgtcgctggaggagcggggtgcgcaacattagctagttggtgaggtaacggcccaccaaggcgatgatgtttagcggggttgagagactgatccgccacactgggactgagatacggcccagactcctacgggaggcagcagtagggaatattccacaatggacgaaagtctgatggagcgacacagcgtgcaggatgaaggccctatgggttgtaaactgctgtggtaagggaataaaaaatagtgtaggaaatgccactatattgaatgtaccttattagaaagcaacggctaactatgtgccagcagccgcggtaatacataggttgcaagcgttatccggaattattgggcgtaaagcgtctgtaggttgtttgttaagtctggcgttaaattttggggctcaaccccaaaccgcgttggatactggcagactagagttatgtagaggttagcggaattccttgtgaagcggtgaaatgcgtagatataaggaagaacaccaacatggcgaaggcagctaactggacatacactgacactgagagacgaaagcgtggggagcaaacaggattagataccctggtagtccacgccctaaacgttgatcattagctgatggggaactcatcggcgcagctaacgcattaaatgatccgcctgagtagtacgttcgcaagaataaaacttaaaggaattgacggggacccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttcggttaagtcctgcaacgagcgcaacccttatccttagttactaacattcagttgagcactctagggagactgcccgagtaatcgggaggaaggtggggacgacgtcaaatcatcatgcctcttacgagtggggccacacacgtgctacaatggccggtacaaagtgaagcaacctggtgacagtgagcaaaccacaaaaagccggtctcagttcggattggagtctgcaactcgactccatgaagtcggaatcgctagtaatcgtagatcagctacgctacggtgaatacgttctcgggtcttgtacacaccgcccgtcaaaccatgggagctggtaatgcccgaagtcggtttattaacaaactgcctaaggcaggactggtgactggggttaagtcgtaacaaggtatccctacgagaacgtggggatggattacctcctttcta

SEQ ID NO: 5913 - DNA, 1541 bp, Mycoplasma bovirhinis
  ref <308>: DATABASE ACCESSION NUMBER: NCBI ACCESSION: NZ_LR214972.1
  ref <309>: DATABASE ENTRY DATE: 2019-04-01
  ref <313>: RELEVANT RESIDUES IN SEQ ID NO: (1)..(1541)
ctagatatacacaaaacatgacagtcaattttttcgagagtttgatcctggctcaggatgaacgctggctgtgtgcctaatacatgcatgtcgagcgaagttcattagaacttagcggcgaatgggtgagtaacacgtacttaacatacctcttagattgggataacggtgagaaattatcgctaataccggatacttatataagtcgcatgacttatatataaaagaagccttaaagcttcactaagagattggggtgcggaacattagctagttggtaaggtaatggcttaccaaggcaatgatgtttagcggggttgagagactgatccgccacactgggactgagatacggcccagactcctacgggaggcagcagtagggaattttccacaatggacgaaagtctgatggagcgacacagcgtgcaggatgacggccttcgggttgtaaactgctgttataagggaagaaaaagcattagaggaaatgctagtgccttgacggtaccttgtcagaaagcaacggctaactatgtgccagcagccgcggtaatacataggttgcaagcgttatccggaattattgggcgtaaagcgtctgtaggttgtatgttaagtctggcgtgaaaacttggggctcaaccccaaattgcgttggatactggcatgctagaattgtgtagaggttagcggaattcctagtgaagcggtgaaatgcgtagatattaggaagaacaccaatttggcgaaggcagctaactgggcacatattgacactgagagacgaaagcgtggggagcaaacaggattagataccctggtagtccacgctgtaaacgatgatgattagctgatagagaggtctatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttctgcaaagctatagagatatagcagaggttaacagaatgacagatggtgcatggttgtcgtcagctcgtgtcgtgagatgttcggttaagtcctgcaacgagcgcaacccttgtccttagttaattttttagggagactgcccgagtaattgggaggaaggtggggacgacgtcaaatcatcatgcctcttacgagtggggcaacacacgtgctacaatggatagtacaaagagaagcaacatggtgacatcaagcaaatctcaaaaaactattctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcagggccggtgactggggtgaagtcgtaacaaggtatccctacgagaacgtggggatggattacctcctttcta

SEQ ID NO: 5914 - DNA, 1521 bp, Mycoplasma californicum
  ref <308>: DATABASE ACCESSION NUMBER: NCBI ACCESSION: NZ_LR215022.1
  ref <309>: DATABASE ENTRY DATE: 2019-04-01
  ref <313>: RELEVANT RESIDUES IN SEQ ID NO: (1)..(1521)
aatttttgagagtttgatcctggctcaggatgaacgctggctgtgtgcctaatacatgcatgtcgagcgaggtgcttgcacctagcggcgaatgggtgagtaacacgtacttaacataccttatagtttgggataacgtttggaaacaggcgctaataccgaatatctgtttttatcgcatgatgaaaacatgaaaggagcttctggcttcgctattggattggggtgcggaatattagttagttggtggggtaatggctcaccaagacgatgatatttagccgggttgagagaccgaccggccacactgggactgagatacggcccagactcctacgggaggcagcagtagggaatattccacaatgagcgaaagcttgatggagcgacacagcgtgaacgatgaagcccttcggggtgtaaagttctgttataagagaagaaaaaactagggaggaaatgccttagtcttgacggtatcttatcagaaagtgacggctaactatgtgccagcagccgcggtaatacataggtcacgagcgttatccgaaattattgggcgtaaagcgtccgtaggttgtttgttaagtctgacgttaaatcttggggctcaaccccattccgcgttggatactggcaagctagagttatatagaggttagtggaattcaatgtgaagcggtggaatgcgtagatatattgaagaacaccaatggcgaaggcagctaactgggtataaactgacactgagggacgaaagcgtggggagcaaacaggattagataccctggtagtccacgccgtaaacgatgatcattagttggtggcaaagtcactaacacagctaacgcattaaatgatccgcctgagtagtatgctcgcaagagtgaaacttaaaggaattgacggggatccgcacaagcggtggagcatgtggtttaatttgaagatacgcgtagaaccttacccacacttgacatcttctgcaatgctatagagatatagtggaggttaacagaatgacaggtggtgcatggttgtcgtcagctcgtgtcgtgagatgtttggttaagtcctgcaacgagcgcaacccttatcattatttaccatcatttagttggggactataatgagactgcccgagtaatcgggaggaaggtggggacgacgtcaaatcatcatgcctcttacgtgtggggcaacacacgtgctacaatggtcgatacaaagagaagcaacccggcgacggtgagcaaacctcaaaaaatcgatctcagttcggattggagtctgcaactcgactccatgaagtcggaatcgctagtaatcgtaggtcagctatactacggtgaatacgttctcggatcttgtacacaccgcccgtcacaccatgggagctggaaatgcccgaagccggttagttaacttcggaggcaactgtctaaggcaggtccggtgactggggtgaagtcgtaacaaggtatccctacgagaacgtggggatggatcacctcctttcta

SEQ ID NO: 5915 - DNA, 1541 bp, Mycoplasma canis
  ref <308>: DATABASE ACCESSION NUMBER: NCBI ACCESSION: NZ_LR215010.1
  ref <309>: DATABASE ENTRY DATE: 2019-04-01
  ref <313>: RELEVANT RESIDUES IN SEQ ID NO: (1)..(1541)
ctagatatacacaaaacatgacagtcaattttttcgagagtttgatcctggctcaggatgaacgctggctgtgtgcctaatacatgcatgtcgagcggagttcttcggaacttagcggcgaatgggtgagtaacacgtacttaacatgccttttagattgggacaacgatgagaaattatcgctaataccggatacttatatggttcgcatgaactatatataaaagaagcctttaaagcttcactaaaagattggggtgcggaacattagctagttggtaaggtaatggcttaccaaggcgatgatgtttagcggggttgagagactgatccgccacactgggactgagatacggcccagactcctacgggaggcagcagtagggaattttccacaatggacgaaagtctgatggagcgacacagcgtgcaggatgaaggccttcgggttgtaaactgctgttataagggaagaaaaagcagtagaggaaatgctattgccttgacggtaccttgtcagaaagcaacggctaactatgtgccagcagccgcggtaatacataggttgcaagcgttatccggaattattgggcgtaaagcgtctgtaggttgtatgttaagtctggcgtgaaaacttggggctcaaccccaaattgcgttggatactggcatgctagaattgtgtagaggttagcggaattcctagtgaagcggtgaaatgcgtagatattaggaagaacatcaacatggcgaaggcagctaactgggcacatattgacactgagagacgaaagcgtggggagcaaacaggattagataccctggtagtccacgctgtaaacgatgatgattagctgatagtagaactatcggcacagctaacgcattaaatcatccgcctgagtagtatgctcgcaagagtgaaacttaaaggaattgacggggatccgcacaagcggtggagcatgtggtttaatttgaagatactcgtagaaccttacccactcttgacatcttccgcaaaactatagagatatagtggaggctaacggaatgacagatggtgcatggttgtcgtcagctcgtgtcgtgagatgttcggttaagtcctgcaacgagcgcaacccttgtccttagttaattttctagggagactgcccgagtaattgggaggaaggtggggacgacgtcaaatcatcatgcctcttacgagtggggcaacacacgtgctacaatggatggtacaaagagaagcaaaacggcgacgtcaagcaaatctcaaaaaaccattctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcagggccggtgactggggtgaagtcgtaacaaggtatccctacgagaacgtggggatggattacctcctttcta

SEQ ID NO: 5916 - DNA, 1542 bp, Mycoplasma caviae
  ref <308>: DATABASE ACCESSION NUMBER: NCBI ACCESSION: NZ_UZVY01000001.1
  ref <309>: DATABASE ENTRY DATE: 2019-04-01
  ref <313>: RELEVANT RESIDUES IN SEQ ID NO: (1)..(1542)
ctagatatataaacatgacagtcaattttttcgagagtttgatcctggctcaggatgaacgctggctgtgtgcctaatacatgcatgtcgagcgaaggtagcaataccttagcggcgaatgggtgagtaacacgtgctcaacgtacccttcagtttggcatagcgactggaaacagtcgataattccaaatactcgtaattttcgcatgaagattacgtaaaagaagcgtttgcttcgctgaaggatcggggtgcgtaacattagctagttggtgaggtaacggcccaccaaggcgatgatgtttagcggggttgagagactgaaccgccacactgggactgagatacggcccagactcctacgggaggcagcagtagggaatattccacaatgggcgaaagcctgatggagcgacacagcgtgaaggatgaaggtcctatggattgtaaacttctgtggtgagggaagaaaagacagaataggaaatgattttgttttgacggtaccttattagaaagcaacggctaactatgtgccagcagccgcggtaatacataggttgcaagcgttatccggaattattgggcgtaaagcgtctgtaggttgtttgttaagtctggcgttaaattttggggctcaaccccaaaacgcgttggatactggcagactagagttgtgtagaggttagcggaattccttgtgaagcggtgaaatgcgtagatataaggaagaacaccaatatggcgaaggcagctaactggacatatactgacactgagagacgaaagcgtggggagcaaacaggattagataccctggtagtccacgccctaaacgatgatcattagctgatggggaactcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgttcggttaagtcctgcaacgagcgcaacccttatccttagttactaccatttagttgaggactctaaggagactgcccgagtaatcgggaggaaggtggggatgacgtcaaatcatcatgcctcttacgagtggggcaacacacgtgctacaatggccggtacaaagagaagcgaagtggtgacatggagcaaacctcaaaaaaccggtctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttcta

SEQ ID NO: 5917 - DNA, 1534 bp, Mycoplasma citelli
  ref <308>: DATABASE ACCESSION NUMBER: NCBI ACCESSION: NZ_LR215036.1
  ref <309>: DATABASE ENTRY DATE: 2019-04-01
  ref <313>: RELEVANT RESIDUES IN SEQ ID NO: (1)..(1534)
atataacaatacatgacagtcaattttttcgagagtttgatcctggctcaggatgaacgctggctgtgtgcctaatacatgcatgtcgagcggagtttatttataaacttagcggcgaatgggtgagtaacacgtacttaacgtaccctttagattggaataacgctgagaaattagcgctaatgccggatatttattaccaacgcatgttggtaatatcaaagaagcgtttgcttcactaaaggatcggggtgcggaacattagctagttggtaaggtaaaagcttaccaaggcgatgatgtttagcggggttgagagactgaaccgccacactgggactgagatacggcccagactcctacgggaggcagcagtagggaattttccacaatgagcgaaagcttgatggagcgacacagcgtgcaggaggacggccttcgggttgtaaactgctgttataagggaagaaaaagtagtgtaggaaatgacattaccttgacggtaccttgtcagaaagcaacggctaactatgtgccagcagccgcggtaatacataggttgcaagcgttatccggaattattgggcgtaaagcgtctgtaggttgtttattaagtctggcgtcaaaacttggggctcaaccccaaatcgcgttggatactgataaactagagttatttagaggttaatggaattccttgtgaagcggtggaatgcgtagatataaggaagaacaccaacatggcgaaggcaattaactgggaatacactgacactgagagacgaaagcgtggggagcaaacaggattagataccctggtagtccacgccgtaaacgatgatgattagctgatggacaccatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttcggttaagtcctgcaacgagcgcaacccttgtccttagttaaatgttctaaggagactgcctaggtaactgggaggaaggtggggacgacgtcaaatcatcatgcctcttacgagtggggcaacacacgtgctacaatggatagtacaaagagaagcaagatggcaacatggagcaaatctcaaaaaactattctcagttcggattgaagtctgcaactcgacttcatgaagtcggaatcgctagtaatcgtagatcagctacgctacggtgaatacgttctcgggtcttgtacacaccgcccgtcaaaccacgggagctggtaatgcccgaagtcggttttgttaactacggaaacaaccgcctaaggcaggactggtgactggggttaagtcgtaacaaggtatccctacgagaacgtggggatggatcacctcctttcta

SEQ ID NO: 5918 - DNA, 1547 bp, Mycoplasma columbinasale
  ref <308>: DATABASE ACCESSION NUMBER: NCBI ACCESSION: NZ_LR215043.1
  ref <309>: DATABASE ENTRY DATE: 2019-04-01
  ref <313>: RELEVANT RESIDUES IN SEQ ID NO: (1)..(1547)
ctagatatagataaacatgacagtcaatttttttcaagagtttgatcctggctcaggatgaacgctggctgtgtgcctaatacatgcatgtcgagcgaagttcttcggaacttagcggcgaatgggtgagtaacacgtactcaacgtaccctttagcttgagatagcagttggaaacaactgataatatcaaatacgcatctttgtcgcatgatgaagatgtaaaagaaccttcacgggttcgctaaaggatcggggtgcgcaacattagctagttggtgaggtaacggcccaccaaggcgatgatgtttagcggggttgagagactgaaccgccacactgggactgagatacggcccagactcctacgggaggcagcagtagggaatattccacaatggacgaaagtctgatggagcgacacagcgtgcaggatgaaggccccatgggttgtaaactgctgtggtaagggaagaaaaaaccgaagaggaaatgctttggtcttgacggtaccttattagaaagcaacggctaactatgtgccagcagccgcggtaatacataggttgcaagcgttatccggaattattgggcgtaaagcgtctgtaggttgtttgttaagtctggcgtcaaaacttggggctcaaccccaaatcgcgttagatactggcatactagagttatgtagaggttagcggaattccttgtgaagcggtgaaatgcgtagagataaggaagaacaccaatatggcgaaggcagctaactggacatatactgacactgagagacgaaagcgtggggagcaaacaggattagataccctggtagtccacgccctaaacgatgatcattagctgatggaaaattcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaacgctatagagatatagttgaggttaacagaatgacagatggtgcatggttgtcgtcagctcgtgtcgtgagatgttcggttaagtcctgcaacgagcgcaacccttatccttagttactaacatttagttgagcactctagggagactgcccgagtaattgggaggaaggtggggacgacgtcaaatcatcatgcctcttacgagtggggcaacacacgtgctacaatggtcggtacaaagagacgcaaactggtgacagggagcaaacctcaaaaaaccgatctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttattaacaaactgcctaaggcaggactggtgactggggttaagtcgtaacaaggtatccctacgagaacgtggggatggatcgcctcctttcta

SEQ ID NO: 5919 - DNA, 1534 bp, Mycoplasma columbinum
  ref <308>: DATABASE ACCESSION NUMBER: NCBI ACCESSION: NZ_LR215041.1
  ref <309>: DATABASE ENTRY DATE: 2019-04-01
  ref <313>: RELEVANT RESIDUES IN SEQ ID NO: (1)..(1534)
taaacatgacagtcaattttttcgagagtttgatcctggctcaggatgaacgctggctgtgtgcctaatacatgcatgtcgagcgaagttcttcggaacttagcggcgaatgggtgagtaacacgtactcaacgtaccctttagattgggatagcggttggaaacagccgataataccaaatatgcacatttttcgcatgaaaggtgtgtgaaaggagcaattgttccgctaaaggagcggggtgcgcaacattagctagttggtgaggtaacggcccaccaaggcgatgatgtttagcggggttgagagactgaaccgccacactgggactgagatacggcccagactcctacgggaggcagcagtagggaatattccacaatggacgaaagtctgatggagcgacacagcgtgcaggatgaaggccccatgggttgtaaactgctgtggtaagggaagaaaaagcagaagagtggaacgcttttgccttgacggtaccttattagaaagcgacggctaactatgtgccagcagccgcggtaatacataggtcgcaagcgttatccggaattattgggcgtaaagcgtctgtaggttgtttgttaagtctgacgtcaaattttggggctcaaccccaaaccgcgttggatactggcatactagagttatgtagaggttagcggaattccttgtgaagcggtggaatgcgtagatataaggaagaacaccaatatggcgaaggcagctaactggacatatactgacactgagagacgaaagcgtggggagcaaacaggattagataccctggtagtccacgccctaaacgatgatcattagctgatggaaaattcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgtacggttaagtcctgcaacgagcgcaacccttgtccttagttactaacattaagttgagcactctaaggagactgcccgagtaattgggaggaaggtggggacgacgtcaaatcatcatgcctcttacgagtggggcaacacacgtgctacaatggtcggtacaaagagaagcaaactggtgacagggagcaaacctcaaaaaaccgatctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttcta

SEQ ID NO: 5920 - DNA, 1525 bp, Mycoplasma columborale
  ref <308>: DATABASE ACCESSION NUMBER: NCBI ACCESSION: NZ_LR215039.1
  ref <309>: DATABASE ENTRY DATE: 2019-04-01
  ref <313>: RELEVANT RESIDUES IN SEQ ID NO: (1)..(1525)
atacatgacagtcaattttttcgagagtttgatcctggctcaggatgaacgctggctgtgtgcctaatacatgcatgtcgagcggagttcttttagaacttagcggcgaatgggtgagtaacacgtacttaacgtgccctctagattggaataacgctgagaaattagcgctaatgccggatacttattattaacacatgttgataatataaaaggagcgtttgcttcactagaggatcggggtgcggaacattagctagttggtagggtaatggcctaccaaggcgatgatgtttagcggggttgagagactgaaccgccacactgggactgagatacggcccagactcctacgggaggcagcagtagggaattttccacaatgagcgaaagcttgatggagcgacacagcgtgcaggatgacggccttcgggttgtaaactgctgttataagggaagaaaaagcagtagaggaaatgctattgccttgacggtaccttgtcagaaagcaacggctaactatgtgccagcagccgcggtaatacataggttgcaagcgttatccggaattattgggcgtaaagcgtctgtaggttgtttgttaagtctggcgtcaaaacttggggctcaaccccaaatcgcgttggatactggcaaactagagttatttagaggttaattgaattccttgtgaagcggtggaatgcgtagatataaggaagaacaccaacatggcgaaggcaattaactgggaatacactgacactgagagacgaaagcgtggggagcaaacaggattagataccctggtagtccacgccgtaaacgatgatgattagctgatggacaccatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttccgcaaagctatagagatatagtggaggttaacggaatgacagatggtgcatggttgtcgtcagctcgtgtcgtgagatgttcggttaagtcctgcaacgagcgcaacccttgtccttagttagatgatctaaggagactgcccaggtaactgggaggaaggtggggatgacgtcaaatcatcatgcctcttacgagtggggcaacacacgtgctacaatggacggtacaaagagaagcaatacggcgacgtggagcaaatctcaaaaaaccgttctcagttcggattgaagtctgcaactcgacttcatgaagtcggaatcgctagtaatcgtagatcagctacgctacggtgaatacgttctcgggtcttgtacacaccgcccgtcaaaccacgggagctggtaatgcccgaagtcggttttgttaactacggaaacaaccgcctaaggcaggactggtgactggggttaagtcgtaacaaggtatccctacgagaacgtggggatggatcacctcctttcta

SEQ ID NO: 5921 - DNA, 1542 bp, Mycoplasma conjunctivae
  ref <308>: DATABASE ACCESSION NUMBER: NCBI ACCESSION: NZ_LR215003.1
  ref <309>: DATABASE ENTRY DATE: 2019-04-01
  ref <313>: RELEVANT RESIDUES IN SEQ ID NO: (1)..(1542)
ctagatatataaacatgacagtcaattttttcgagagtttgatcctggctcaggatgaacgctggctgtgtgcctaatacatgcatgtcgagcgaaggtagcaataccttagcggcgaatgggtgagtaacacgtgctcaacgtacccttcagtttggcatagcgactggaaacagtcgataatttcaaatactcgtagttttcgcatgaagattacggaaaagaagcgtttgcttcgctggaggagcggggtgcgtaacattagctagttggtgaggtaacggcccaccaaggcgatgatgtttagcggggttgagagactgaaccgccacactgggactgagatacggcccagactcctacgggaggcagcagtagggaatattccacaatgggcgaaagcctgatggagcgacacagcgtgaaggatgaaggtcctatggattgtaaacttctgtggtaagggaagaaaagacagaataggaaatgattttgttttgacggtaccttattagaaagcaacggctaactatgtgccagcagccgcggtaatacataggttgcaagcgttatccggaattattgggcgtaaagcgtctgtaggttgtttgttaagtctggcgttaaattttggggctcaaccccaaaacgcgttggatactggcaggctagagttgtgtagaggttagcggaattccttgtgaagcggtgaaatgcgtagatataaggaagaacaccaagatggcgaaggcagctaactggacatatactgacactgagagacgaaagcgtggggagcaaacaggattagataccctggtagtccacgccctaaacgatgatcattagctgatggggaactcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgtttggttaagtcctgcaacgagcgcaacccttatccttagttactaccatttagttgaggactctaaggagactgcccgagtaatcgggaggaaggtggggatgacgtcaaatcatcatgcctcttacgagtggggcaacacacgtgctacaatggccggtacaaagagaagcgaagtggtgacatggagcaaacctcaaaaaaccggtctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttcta

SEQ ID NO: 5922 - DNA, 1527 bp, Mycoplasma cynos
  ref <308>: DATABASE ACCESSION NUMBER: NCBI ACCESSION: NZ_LR214980.1
  ref <309>: DATABASE ENTRY DATE: 2019-04-01
  ref <313>: RELEVANT RESIDUES IN SEQ ID NO: (1)..(1527)
acatgacagtcaattttttcgagagtttgatcctggctcaggatgaacgctggctgtgtgcctaatacatgcatgtcgagcggagttcttttaggacttagcggcgaatgggtgagtaaccacgtacttaacatgcctcttagattgggacaacgatgagaaattatcgctaataccggatacttatatagtttgcataaactatatataaaaggagctttacagcttcactaagagattggggtgcggaacattagctagttggtagggtaaaggcctaccaaggcgatgatgtttagcggggttgagagactgaaccgccacactgggactgagatacggcccagactcctacgggaggcagcagtagggaattttccacaaatgggcgaaagtctgatggagcgacacagcgtgcaggatgaaggccttcgggttgtaaactgctgttataagggaagaaaaaacaatagaggaaatgctattgtcttgacggtaccttgtcagaaagcaacggctaactatgtgccagcagccgcggtaatacataggttgcaagcgttatccggaattattgggcgtaaagcgtctgtaggttgtatgttaagtctggcgtgaaaacttggggctcaacccaaattgcgttggatactggcatactagaattgtgtagaggttagcggaattcctagtgaagcggtgaaatgcgtagatattaggaagaacatcaacatggcgaaggcagctaactgggcacatattgacactgagagacgaaagcgtggggagcaaacaggattagataccctggtagtccacgctgtaaacgatgatgattagctgatagtagaactatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttctgcaaagctatagagatatagtggaggctaacagaatgacagatggtgcatggttgtcgtcagctcgtgtcgtgagatgttcggttaagtcctgcaacgagcgcaacccttgtccttagttaaatttttaaggagactgcccgagtaattgggaggaaggtggggacgacgtcaaatcatcatgcctcttacgagtggggcaacacacgtgctacaatggacggtacaaagagaagcaaaatggtgacatcaagcaaatctcaaaaaaccgttctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcaggaccggtgactggggtgaagtcgtaacaaggtatccctacgagaacgtggggatggattacctcctttcta

SEQ ID NO: 5923 - DNA, 1535 bp, Mycoplasma dispar
  ref <308>: DATABASE ACCESSION NUMBER: NCBI ACCESSION: NZ_LR214971.1
  ref <309>: DATABASE ENTRY DATE: 2019-04-01
  ref <313>: RELEVANT RESIDUES IN SEQ ID NO: (1)..(1535)
aatcatgagagtttgatcctagctcaggatgaacgctagctgtgtgcttaatacatgcatgttgaacggaatgttctagtttactagaatatttagtagcaaatgggtgagtaacacgtacctaacctaccttttggaccgggataaccattggaaacagtggctaataccagatataatagaaattcgcatgagtttttatcaaaaggagcctttaaagctccaccaaaaaatgggggtgcgcaacattagttagttggcagggtaaaagcctaccaagacgatgatgtttagcggggccaagaggttgtaccgccacactgggattgagatacggcccagactcctacgggaggcagcagtaaggaatattccacaatgagcgaaagcttgatggagcgacacagcgtgcaggatgaagtctttagggatgtaaactgctgttgtaagggaagaaaaaactagataggaaatgatctagtcttgacggtaccttattagaaagcgacggcaaactatgtgccagcagccgcggtaatacataggtcgcaagcgttatccggaattattgggcgtaaagcgtccgtaggttttttgttaagtttaaggttaaatgctaaagctcaactttagtccgctttagatactggcaaaatagaattatgaagaggttagcggaattcctagtggagcggtggaatgcgtagatattaggaagaacaccaataggcgaaggcagctaactggtcatatattgacactaagggacgaaagcgtggggagcaaacaggattagataccctggtagtccacgccgtaaacgatgatcattagttggtggcaaaagtcactagcacagctaacgcgttaaatgatccgcctgagtagtatgctcgcaagagtgaaacttaaaggaattgacgggaacccgcacaagcggtggagcatgtggtttaatttgaagatacgcgtagaaccttacccactcttgacatcctcgcaaagctatagagatatagtggaggctaacgagatgacagatggtgcatggttgtcgtcagctcgtgtcgtgagatgttaggttaagtcctgcaacgagcgcaacccttttctttagttgctaacattaagttgagaaccctagagatactgccggtgcaaaccggaggaaggtggggatgacgtcaaatcatcatgcctcttacgagtggggcaacacacgtgctacaatggctactacaaagagcagcaaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacctcggagaccattgcctaaggcaggaccgatgactggggtgaagtcgtaacaaggtatccctacgagaacgtggggatggaacacctcctttcta

SEQ ID NO: 5924 - DNA, 1539 bp, Mycoplasma edwardii
  ref <308>: DATABASE ACCESSION NUMBER: NCBI ACCESSION: NZ_LS991951.1
  ref <309>: DATABASE ENTRY DATE: 2019-04-01
  ref <313>: RELEVANT RESIDUES IN SEQ ID NO: (1)..(1539)
ctagatatacacaaaacatgacagtcaattttttcgagagtttgatcctggctcaggatgaacgctggctgtgtgcctaatacatgcatgtcgagcggagttcttaggaacttagcggcgaatgggtgagtaacacgtacttaacatgccttttagattgggacaacgatgagaaattatcgctaataccggatacttatatggttcgcatgaactatatataaaaggagctttacggcttcactaaaagattggggtgcggaacattagctagttggtaaggtaatggcttaccaaggcgatgatgtttagcggggttgagagactgatccgccacactgggactgagatacggcccagactcctacgggaggcagcagtagggaattttccacaatggacgaaagtctgatggagcgacacagcgtgcaggatgaaggccttcgggttgtaaactgctgttataagggaagaaaaagcagtagaggaaatgctattgccttgacggtaccttgtcagaaagcaacggctaactatgtgccagcagccgcggtaatacataggttgcaagcgttatccggaattattgggcgtaaagcgtctgtaggttgtttgttaagtctggcgtgaaaacttggggctcaaccccaaattgcgttggatactggcaagctagaattgtgtagaggttagcggaattcctagtgaagcggtgaaatgcgtagatattaggaagaacaccaacatggcgaaggcagctaactgggcacatattgacactgagagacgaaagcgtggggagcaaacaggattagataccctggtagtccacgctgtaaacgatgatgattagctgatagaaaactatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttccgcaaagctatagagatatagtggaggctaacggaatgacagatggtgcatggttgtcgtcagctcgtgtcgtgagatgttcggttaagtcctgcaacgagcgcaacccttgtccttagttaattttctagggagactgcccgagtaattgggaggaaggtggggacgacgtcaaatcatcatgcctcttacgagtggggcaacacacgtgctacaatggacggtacaaagagaagcaagacggcgacgtggagcaaatctcaaaaaaccgttctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcagggccggtgactggggtgaagtcgtaacaaggtatccctacgagaacgtggggatggattacctcctttcta

SEQ ID NO: 5925 - DNA, 742 bp, Mycoplasma fermentans
  ref <308>: DATABASE ACCESSION NUMBER: NCBI ACCESSION: NZ_ATFH01000027.1
  ref <309>: DATABASE ENTRY DATE: 2019-04-01
  ref <313>: RELEVANT RESIDUES IN SEQ ID NO: (1)..(742)
aacaggattagataccccggtagtccacgccctaaacgatgatcattagctgatggggaactcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgtttggttaagtcctgcaacgagcgcaacccttatccttagttactaccatttagttgaggactctaaggagactgcccgagtaatcgggaggaaggtggggatgacgtcaaatcatcatgcctcttacgagtggggcaacacacgtgctacaatggccggtacaaagagaagcgaagtggtgacatggagcaaacctcaaaaaaccggtctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttcta

SEQ ID NO: 5926 - DNA, 1528 bp, Mycoplasma gallinaceum
  ref <308>: DATABASE ACCESSION NUMBER: NCBI ACCESSION: NZ_LR214950.1
  ref <309>: DATABASE ENTRY DATE: 2019-04-01
  ref <313>: RELEVANT RESIDUES IN SEQ ID NO: (1)..(1528)
tacatgacagtcaattttttcgagagtttgatcctggctcaggatgaacgctggctgtgtgcctaatacatgcatgtcgagcggagttcttcggaacttagcggctaatgggtgagtaacacgtacttaacgtgcccccttgattgggataacgctgagaaattagcgctaataccggatacttaaatatctcgcatgaggtatttataaaaggagcctttaaagcttcacaaggggatcggggtgcgtaacattagctagttggtgaggtaatggctcaccaaggcgatgatgtttagcggggttgagagactgatccgccacactgggactgagatacggcccagactcctacgggaggcagcagtagggaattttccacaatgggcgaaagcctgatggagcgacacagcgtgcaggatgaaggccttcgggttgtaaactgctgttataagggaagaaaaagtcgaggaggaaatgccttgaccttgacggtaccttatcagaaagcaacggctaactatgtgccagcagccgcggtaatacataggttgcaagcgttatccggaattattgggcgtaaagcgtctgtaggttgtttgttaagtctggtgtgaaaacttggggctcaaccccaaattgcattggatactggcaaactagaattgtgtagaggttagcggaattccttgtgaagcggtggaatgcgtagatataaggaagaacatcaacatggcgaaggcagctaactggacatatattgacactgagagacgaaagcgtggggagcaaacaggattagataccctggtagtccacgccgtaaacgatgatgattagctgatggggaactcatcggcgcagctaacgcattaaatcatccgcctgagtagtatgctcgcaagagtgaaacttaaaggaattgacggggatccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttcggttaagtcctgcaacgagcgcaacccttgtccttagttaaacgttctagggagactgcccgggtaaccgggaggaaggtggggacgacgtcaaatcatcatgcctcttacgagtggggcaacacacgtgctacaatggatggtacaaagagacgcaatacggcgacgtggagcaaatctcaaaaaaccattctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggagacaactgcctaaggcaggactggtgactggggtgaagtcgtaacaaggtatccctacgagaacgtggggatggattacctcctttcta

SEQ ID NO: 5927 - DNA, 1520 bp, Mycoplasma gallisepticum
  ref <308>: DATABASE ACCESSION NUMBER: NCBI ACCESSION: NZ_LS991952.1
  ref <309>: DATABASE ENTRY DATE: 2019-04-01
  ref <313>: RELEVANT RESIDUES IN SEQ ID NO: (1)..(1520)
ttttctgagagtttgatcctggctcaggattaacgctggcggcatgcctaatacatgcaagtcgatcggatgtagcaatacattagaggcgaacgggtgagtaacacgtatccaatctgccttatagtgggggataactagtcgaaagattagctaataccgcataacaagttaactatcgcatgagaataactttaaagaagcaactgcttcgctataagatgagggtgcggcatatcagctagttggtgaggataatggcccaccaaggcgatgacgtgtagttatgctgagaggtagaataaccacaatgggactgagacacggcccatactcctacgggaggcagcagtagggaatttttcacaatggacgaaagtctgatggagcaatgccgcgtgaacgatgaaggtctttttagattgtaaagttcttttatttgggaagaacagttaatagagtggaaagctattaatttgactgtaccatttgaataagtaacgactaactatgtgccagcagtcgcggtaatacataggttgcaagcgttatccggatttattgggcgtaaaacaagcgcaggcggattagaaagtctggtgttaaaagcaattgcttaacgattgtatgcattggaaacttctagtctagagtttggtagagagtcctggaactccatgtggagcggtgaaatgcgtagatatatggaagaacaccagaggcgaaggcgaggacttgggccaatactgacgcttaggcttgaaagtgtggggagcaaataggattagataccctagtagtccacactgtaaacgatggatgttaagtgtcggagcgaatacttcggtgctgcagttaacacattaaacatcctgcctgagtagtacattcgcaagaatgaaactcaaacggaattgacggggacccgcacaagtggtggagcatgttgcttaattcgacggtacacgaaaaaccttacctagacttgacatcttgggcgaagctatagaaatatagtggaggtcaacccaatgacaggtggtgcatggttgtcgtcagctcgtgtcgtgagatgttgggttaagtcccgcaacgagcgcaacccttatcgttagttactttgtctaacgagactgccaacgtaagttggaggaaggtggggatgacgtcaaatcatcatgccccttatgtctagggctgcaaacgtgctacaatggccaatacaatcagttgcaaatccgtaaggtggagctaatctgtaaagttggtctcagttcgtattgagggctgcaattcgccctcatgaagtcggaatcactagtaatcgcgaatcagccatgtcgcggtgaatacgttctcgggtcttgtacacaccgcccgtcaaactatgagagctggtaatatctaaaaccgtgttgctaaccgcaaggaagcgcatgtctagggtagggccggtgattggagttaagtcgtaacaaggtacccctacgagaacgtgggggtggattacctcctttcta

SEQ ID NO: 5928 - DNA, 1538 bp, Mycoplasma gallopavonis
  ref <308>: DATABASE ACCESSION NUMBER: NCBI ACCESSION: NZ_LR215031.1
  ref <309>: DATABASE ENTRY DATE: 2019-04-01
  ref <313>: RELEVANT RESIDUES IN SEQ ID NO: (1)..(1538)
ctagatatatacaatacatgacagtcaattttttcgagagtttgatcctggctcaggatgaacgctggctgtgtgcctaatacatgcatgtcgagcggagttcttcggaacttagcggcgaatgggtgagtaacacgtacttaacgtgcccactagattggaataacgctgagaaattagcgctaatgccggatacttattaatttcgcatgaagttaatataaaaggagcaattgcttcactagtggatcggggtgcgtaacattagctagttggtaaggtaatggcttaccaaggcgatgatgtttagcggggttgagagactgatccgccacactgggactgagatacggcccagactcctacgggaggcagcagtagggaattttccacaatggacgaaagtctgatggagcgacacagcgtgcaggatgaaggccttcgggttgtaaactgctgttataagggaagaaaaaacaaaggagtggaaagcctttgtcttgacggtaccttgtcagaaagcaacggctaactatgtgccagcagccgcggtaatacataggttgcaagcgttatccggaattattgggcgtaaagcgtctgtaggttgtgtgttaagtctgacgtcaaaacttggggctcaaccccaaatcgcgttggatactggcacgctagaattgtgtagaggttagcggaattcctagtgaagcggtgaaatgcgtagatattaggaagaacatcaacatggcgaaggcagctaactgggcacatattgacactgagagacgaaagcgtggggagcaaacaggattagataccctggtagtccacgccgtaaacgatgatgattagctgatggagaccatcggcgcagctaacgcattaaatcatccgcctgagtagtatgcacgcaagtgtgaaacttaaaggaattgacggggatccgcacaagcggtggagcatgtggtttaatttgaagatacgcgtagaaccttacccactcttgacatcttccgcaaagctatagagatatagtcgaggttaacggaatgacagatggtgtatggttgtcgtcagctcgtgtcgtgagatgttcggttaagtcctgcaacgagcgcaacccttgtccttagttagatgatctaaggagactgcccgagtaattgggaggaaggtggggacgacgtcaaatcatcatgcctcttacgagtggggccacacacgtgctacaatggacggtacaaagagaagcaaaacggcgacgtcaagcaaatctcaaaaaaccgttctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggttttgttaactacggaaacaaccgcctaaggcaggactggtgactggggtgaagtcgtaacaaggtatccctacgagaacgtggggatggattacctcctttcta

SEQ ID NO: 5929 - DNA, 1539 bp, Mycoplasma glycophilum
  ref <308>: DATABASE ACCESSION NUMBER: NCBI ACCESSION: NZ_LR215024.1
  ref <309>: DATABASE ENTRY DATE: 2019-04-01
  ref <313>: RELEVANT RESIDUES IN SEQ ID NO: (1)..(1539)
ctagatatatacaatacatgacagtcaattttttcgagagtttgatcctggctcaggatgaacgctggctgtgtgcctaatacatgcatgtcgagcggagttcttcggaacttagcggcgaatgggtgagtaacacgtacttaacgtgccttctagattggaataacgctgagaaattagcgctaatgccggatacttatatggttcgcatgaactatatataaaagaagctttcaagcttcactagaagatcggggtgcgtaacattagctagttggtaaggtaatggcttaccaaggcgatgatgtttagcggggttgagagactgatccgccacactgggactgagatacggcccagactcctacgggaggcagcagtagggaattttccacaatgggcgaaagcctgatggagcgacacagcgtgcaggatgaaggccttcgggttgtaaactgctgttataagggaagaaaaaatcgtggaggaaatgccatgatcttgacggtaccttgtcagaaagcaacggctaactatgtgccagcagccgcggtaatacataggttgcaagcgttatccggaattattgggcgtaaagcgtctgtaggttgtgtgttaagtctgacgtcaaaacttggggctcaaccccaaatcgcgttggatactggcatactagaattgtgtagaggttagcggaattcctagtgaagcggtgaaatgcgtagatattaggaagaacaccaacatggcgaaggcagctaactgggcacatattgacactgagagacgaaagcgtggggagcaaacaggattagataccctggtagtccacgccgtaaacgatgatgattagctgatgggaaccatcggcgcagctaacgcattaaatcatccgcctgagtagtatgcacgcaagtgtgaaacttaaaggaattgacggggatccgcacaagcggtggagcatgtggtttaatttgaagatacgcgtagaaccttacccactcttgacatcttccgcaaagctatagagatatagtggaggttaacggaatgacagatggtgcatggttgtcgtcagctcgtgtcgtgagatgttcggttaagtcctgcaacgagcgcaacccttgtccttagttagatgatctaaggagactgcccgagtaattgggaggaaggtggggacgacgtcaaatcatcatgcctcttacgagtggggcaacacacgtgctacaatggacggtacaaagagaagcaagacggcgacgtggagcaaatctcaaaaaaccgttctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggttttgttaactacggaaacaaccgcctaaggcaggactggtgactggggttaagtcgtaacaaggtatccctacgagaacgtggggatggattacctcctttcta

SEQ ID NO: 5930 - DNA, 1533 bp, Mycoplasma hominis
  ref <308>: DATABASE ACCESSION NUMBER: NCBI ACCESSION: NZ_CP032849.1
  ref <309>: DATABASE ENTRY DATE: 2019-04-01
  ref <313>: RELEVANT RESIDUES IN SEQ ID NO: (1)..(1533)
tttttataagagtttgatcctggctcaggatgaacgctggctgtgtgcctaatacatgcatgtcgagcgaggttagcaataacctagcggcgaatgggtgagtaacacgtgcttaatctaccttttagattggaatacccattggaaacaatggctaatgccggatacgcatggaaccgcatggttccgttgtgaaaggcgctgtaaggcgccactaaaagatgagggtgcggaacattagttagttggtgaggtaatggcccaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttataagggaagaacatttgcaataggaaatgattgcagactgacggtaccttgtcagaaagcgatggctaactatgtgccagcagccgcggtaatacataggtcgcaagcgttatccggaattattgggcgtaaagcgttcgtaggctgtttgttaagtctggagttaaatcccggggctcaaccccggctcgctttggatactagcaaactagagttagatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggagaatcactgacgcagctaacgcattaaatgatccgcctgagtagtatgctcgcaagagtgaaacttaaaggaattgacggggacccgcacaagcggtggagcatgtggtttaatttgaagatacacggaaaaccttacccactcttgacatccttcgcaaagctatagagatatagtggaggttatcggagtgacagatggtgcatggttgtcgtcagctcgtgtcgtgagatgtttggtcaagtcctgcaacgagcgcaacccctatctttagttactaacattaagttgaggactctagagatactgcctgggtaactgggaggaaggtggggatgacgtcaaatcatcatgcctcttacgagtggggccacacacgtgctacaatggtcggtacaaagagaagcaatatggcgacatggagcaaatctcaaaaagccgatctcaggccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgaccgcctaaggtaggactggtgactggggtgaagtcgtaacaaggtatccctacgagaacgtggggatggatcacctcctttcta

SEQ ID NO: 5931 - DNA, 1534 bp, Mycoplasma hyopneumoniae
  ref <308>: DATABASE ACCESSION NUMBER: NCBI ACCESSION: NZ_LR214992.1
  ref <309>: DATABASE ENTRY DATE: 2019-04-01
  ref <313>: RELEVANT RESIDUES IN SEQ ID NO: (1)..(1534)
aatcatgagagtttgatcctggctcaggataaacgctagctgtgtgcttaatacatgcatgttgaacggaatattttagttcgctaaaatatttagtagcaaatgggtgagtaacacgtacctaacctaccttttggactgggataaccattggaaacagtggctaataccagatatgataaaaatttgcatgaatttttattcaaaggagccttcaagcttcaccaagaaatgggggtgcgcaacattagttagttggtagggtaaaagcctaccaagacgatgatgtttagcggggccaagaggttgtaccgccacactgggattgagatacggcccagactcctacgggaggcagcagtaaggaatattccacaataagcgaaagcttgatggagcgacacagcgtgcaggatgaagtctttcgggatgtaaactgctgttgtaagggaagaaaaaactagataggaaatgctctagtcttgacggtaccttattagaaagcgacggcaaactatgtgccagcagccgcggtaatacataggtcgcaagcgttatccggaattattgggcgtaaagcgtccgtaggttttttgttaagtttaaagttaaatgctaaagctcaactttagtccgctttagatactggcaaaatagaattatgaagaggttagcggaattcctagtggagtggtggaatacgtagatattaggaagaacaccaataggcgaaggcagctaactggtcatatattgacactaagggacgaaagcgtggggagcaaacaggattagataccctggtagtccacgccgtaaacgatgatcattagttggtggcaaaagtcactaacacagctaacgcgttaaatgatccgcctgagtagtatgctcgcaagagtgaaacttaaaggaattgacgggaacccgcacaagcggtggagcatgtggtttaatttgaagatacgcgtagaaccttacccactcttgacattctcgcaaaactatagagatatagccgaggctaacgagatcacagatggtgcatggttgtcgtcagctcgtgtcgtgagatgttaggttaagtcctgcaacgagcgcaacccttttctttagttgctaacatttagttgagaaccctaaagatactgccggcgcaagccggaggaaggtggggacgacgtcaaatcatcatgcctcttacgagtggggcaacacacgtgctacaatggctactacaaagagcagcaaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacttcggagaccattgcctaaggcaggaccgatgactggggtgaagtcgtaacaaggtatccctacgagaacgtggggatggaacacctcctttcta

SEQ ID NO: 5932 - DNA, 1528 bp, Mycoplasma hyorhinis
  ref <308>: DATABASE ACCESSION NUMBER: NCBI ACCESSION: NZ_LR214949.1
  ref <309>: DATABASE ENTRY DATE: 2019-04-01
  ref <313>: RELEVANT RESIDUES IN SEQ ID NO: (1)..(1528)
ttttttgagagtttgatcctagctcaggatgaacgctcgctgtgtgcctaatacatgcatgttgaacgggatgtagcaatacattcagtagcgaatgggtgagtaacacgtacctaacctacctttaagactgggataactattggaaacaatagctaataccggatatagttatttatcgcatgatgagtaatagaaaggagcttcacagcttcacttaaaaatgggggtgcggaacattagttagttggtagggtaatggcctaccaagacgatgatgtttagctgggccgagaggctgtacggccacactgggactgagatacggcccagactcctacgggaggcagcagtaaggaattttccacaatgagcgaaagcttgatggagcgacacagcgtgcaggatgaagttcttcggaatgtaaactgctgttataagggaagaaaaaatagaataggaaatgattttatcttgacggtaccttattagaaagcgacggcaaactatgtgccagcagccgcggtaatacataggtcgcaagcgttatccggaattattgggcgtaaagcgtccgtaggttttttgctaagtctggagttaaatgctgaagctcaacttcagtccgctttggatactggcaaaatagaattataaagaggttagcggaattcctagtgaagcggtggaatgcgtagatattaggaagaacaccaataggcgaaggcagctaactggttatatattgacactaagggacgaaagcgtggggagcaaacaggattagataccctggtagtccacgccgtaaacgatgatcattagttggtggaataatttcactaacgcagctaacgcgttaaatgatccgcctgagtagtatgctcgcaagagtgaaacttaaaggaattgacgggaacccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttaggttaagtcctgcaacgagcgcaacccttttctttagttactaatattaagttaaggactctagagatactgcctgggtaaccaggaggaaggtggggacgacgtcaaatcatcatgcctcttacgagtggggcaacacacgtgctacaatggtcggtacaaagagaagcaatatggtgacatggagcaaatctcaaaaaaccgatctcagttcggattgaagtctgcaactcgacttcatgaagtcggaatcgctagtaatcgtagatcagctacgctacggtgaatacgttctcgggttttgtacacaccgcccgtcgcaccatgggagttggtaatgcccaaagtcggtgagttaacttcggagaccattgcctaaggcaggactgatgactggggtgaagtcgtaacaaggtatccctacgagaacgtggggatggaacacctcctttcta

SEQ ID NO: 5933 - DNA, 1523 bp, Mycoplasma hyosynoviae
  ref <308>: DATABASE ACCESSION NUMBER: NCBI ACCESSION: NZ_CP008748.1
  ref <309>: DATABASE ENTRY DATE: 2019-04-01
  ref <313>: RELEVANT RESIDUES IN SEQ ID NO: (1)..(1523)
ttttatttaagagtttgatcctggctcaggatgaacgctggctgtgtgcctaatacatgcatgtcgagcgggagtagcaatactctagcggcaaatgggtgagtaacacgtgcttaatctaccttttagattggaatacccaatggaaacattggttaatgccggataagtatgaaatcgcatgatttcgttatgaaagaagcgtttgcttcactaagagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaaaaagcagttgaggaaatgcaactgaactgacggtaccttgttagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttggatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggccaatcactgacgcagctaacgcattaaatgatccgcctgagtagtatgctcgcaagagtaaaacttaaaggaattgacggggacccgcacaagcggtggagcatgtggtttaatttgaggatacgcggagaaccttacccactcttgacatccttcgcaaagctatagagatatagtggaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggctacacacgtgctacaatggtcggtacaaagagaagcaatatggcgacatggagcaaatctcaaaaagccgatctcagttcagattggagtctgcaattcgactccatgaagtcggaatcgctagtaatcgtagatcagctacgctacggtgaatacgttctcgggtcttgtacacaccgcccgtcacaccatgggagctggtaatacccaaagtcggtttgctaacctcggaggcaactgcctaaggtaggactggtgactggggtgaagtcgtaacaaggtatccctacgagaacgtggggatggatcacctcctttcta

SEQ ID NO: 5934 - DNA, 1519 bp, Mycoplasma iowae
  ref <308>: DATABASE ACCESSION NUMBER: NCBI ACCESSION: NZ_LR215023.1
  ref <309>: DATABASE ENTRY DATE: 2019-04-01
  ref <313>: RELEVANT RESIDUES IN SEQ ID NO: (1)..(1519)
aatttttgagagtttgatcctggctcaggattaacgctagcgggatgcctaatacatgcaagtcgaacggggtgcttgcacccagtggcgaacgggtgagtaacacgtatccaacatacctattagtgggggataactggatgaaaatctagctaataccgcataggacattgttatcgcatgagagaatgtttaaagttgcgtttgcaacgcttttagattggggtgcggtgtattagatagttggtgaggtaacggctcaccaagtcaatgatgcatagctgtgctgagaggcagaacagccacaatgggactgagacacggcccatacttctacggaaggcagcagtagggaatttttcacaatgggcgaaagcctgatggagcaatcccgcgtggatgatgaaggtcttatatagattgtaaaatccttttattggagacgaacggcaggaagaggaaatgctttctgtgtgacggtatcctttgaataagtatcggctaactatgtgccagcagccgcggtaatacataggatgcaagcgttattcggatttactgggcgtaaagagagcgcgggcggatctgcaagtctggtgtgaaatacaactgcttaacggttgtatgcattggaaactgcaaatctagagtgtagtagagagttttggaactccatgtggagcggtggaatgcgtagatatatggaagaacaccagtggcgaaggcgaaaacttgggctattactgacgcttatgctcgaaagtgtggggagcaaataggattagataccctagtagtccacaccgtaaacgatggtaattaaatgttggcatggaatatgtcggcgttgcagttaacacattaaattacccgcctgggtagtacattcgcaagaatgaaactcaaacggaattgacggggacccgcacaagtggtggagcatgttgcttaattcgacaatacacgtaaaaccttacctgggtttgacatcctttgcaaagctatagagatatagtggaggttaacagagtgacaggtggtgcatggttgtcgtcagctcgtgtcgtgagatgttgggttaagtcccgcaacgagcgcaacccttattgttagttactttatctagcgagactgccagcgcaagctggaggaaggtggggatgacgtcaaatcatcatgccccttatatccagggccgcaaacgtgctacaatggtcggtacaaactgtcgcaaaccagtaatgggaagccaatcagagaaagccgatctcagttcggattgagggctgcaattcgccctcatgaagttggaatcactagtaatcgcgaatcagccatgtcgcggtgaatacgttctcgggtcttgtacacaccgcccgtcaaactatgagagctggtaatacctaaaaccgttaagataacctcgtgagtcttgcgtctagggtaggactggtgattggagttaagtcgtaacaaggtacccctacgggaatgtgggggtggatcacctcctttctaa

SEQ ID NO: 5935 - DNA, 1545 bp, Mycoplasma maculosum
  ref <308>: DATABASE ACCESSION NUMBER: NCBI ACCESSION: NZ_LR215037.1
  ref <309>: DATABASE ENTRY DATE: 2019-04-01
  ref <313>: RELEVANT RESIDUES IN SEQ ID NO: (1)..(1545)
ctagatatataaacatgacagtcaattttttcgagagtttgatcctggctcaggatgaacgctggctgtgtgcctaatacatgcatgtcgagcgaaggtagcaataccttagcggcgaatgggtgagtaacacgtactcaacgtaccttttagattgggatagctaacggaaacgttggataataccaaatacttattagtttcgcatgaaactaatataaaaggagcctttaaagctccgctgaaagatcggggtgcgcaacattagctagttggtgaggtaacggcccaccaaggcgatgatgtttagcggggttgagagactgaaccgccacactgggactgagatacggcccagactcctacgggaggcagcagtagggaatattccacaatgagcgaaagcttgatggagcgacacagcgtgcaggatgaaggtcctatggattgtaaactgctgtggtaagggaagaaaaagtaacttaggaaatgaagttaccttgacggtaccttattagaaagcaacggctaactatgtgccagcagccgcggtaatacataggttgcaagcgttatccgaaattattgggcgtaaagcgtctgtaggttgtttgttaagtctggcgtcaaattttggggctcaaccccaaaccgcgttggatactggcagactagagttatgtagaggttagcggaattccttgtgaagcggtgaaatgcgtagatataaggaagaacaccattatggcgaaggcggctaactgggcatacactgacactgagagacgaaagcgtggggagcaaacaggattagataccctggtagtccacgccctaaacgatgatcattagctgatggagaattcgtcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttcggttaagtcctgcaacgagcgcaacccttatccttagttactaccattaagttgaggactctaaggagactgccggagtaatccggaggaaggtggggacgacgtcaaatcatcatgcctcttacgagtggggctacacacgtgctacaatggacagtacaaagagaagcaaaatggtgacatcaagcaaacctcaaaaaactgttctcagttcggattgaagtctgcaactcgacttcatgaagttggaatcgctagtaatcgtagatcagctacgctacggtgaatacgttctcgggtcttgtacacaccgcccgtcaaaccatgggagctggtaatgcccgaagtcggtttataaagaaactgcctaaggcaggactggtgactggggttaagtcgtaacaaggtatccctacgagaacgtggggatggattacctcctttcta

SEQ ID NO: 5936 - DNA, 1544 bp, Mycoplasma meleagridis
  ref <308>: DATABASE ACCESSION NUMBER: NCBI ACCESSION: NZ_LR215042.1
  ref <309>: DATABASE ENTRY DATE: 2019-04-01
  ref <313>: RELEVANT RESIDUES IN SEQ ID NO: (1)..(1544)
ctagatatataaacatgacagtcaattttttcgagagtttgatcctggctcaggatgaacgctggctgtgtgcctaatacatgcatgtcgagcgaagtttttcggaacttagcggcgaatgggtgagtaacacgtactcaacgtaccttttagattgggatagcaagtggaaacatttgataataccgaatatgtatatttttcgcatgaaatttatatgaaagaagcctttaagcttcgctaaaagagcggggtgcgtaacattagctagttggtgaggtaacggcccaccaaggcaatgatgtttagcggggttgagagactgaaccgccacactgggactgagatacggcccagactcctacgggaggcagcagtagggaatattccacaatggacgaaagtctgatggagcgacacagcgtgcaggatgaaagccttatgggttgtaaactgctgtggtaagggaagaaaaaataaatgaggaaatgcatttatcctgacggtaccttattagaaagcgacggctaactatgtgccagcagccgcggtaatacataggtcgcaagcgttatccggaattattgggcgtaaagcgtctgtaggttgtttgttaagtctggcgttaaaacttggggctcaaccccaaagcgcgttggatactggcatactagagttacgtagaggttagcggaattccttgtgaagcggtgaaatgcgtagatataaggaagaacaccaacatggcgaaggcagctaactgggcgtatactgacactgagagacgaaagcgtggggagcaaacaggattagataccctggtagtccacgccctaaacgatgatcattagctgatggaaaattcgtcggcgcagctaacgcattaaatgatccgcctgagtagtacgttcgcaagaataaaacttaaaggaattgacggggatccgcacaagcggtggagcatgtggtttaatttgaagatacgcgaagaaccttacccactcttgacatcttctgcaaagctatagagatatagtcgaggttaacagaatgacagatggtgcatggttgtcgtcagctcgtgtcgtgagatgttcggttaagtcctgcaacgagcgcaacccttgtccttagttactagcattaagttgagcactctaaggagactgcccgagtaattgggaggaaggtggggacgacgtcaaatcatcatgcctcttacgagtggggcaacacacgtgctacaatggtcggtacaaagagaagcaaactggtgacagggagcaaacctcaaaaaaccgatctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttaattacaaactgcctaaggcaggactggtgactggggttaagtcgtaacaaggtatccctacgagaacgtggggatggattacctcctttcta

SEQ ID NO: 5937 - DNA, 1531 bp, Mycoplasma mycoides
  ref <308>: DATABASE ACCESSION NUMBER: NCBI ACCESSION: NZ_LS483515.1
  ref <309>: DATABASE ENTRY DATE: 2019-04-01
  ref <313>: RELEVANT RESIDUES IN SEQ ID NO: (1)..(1531)
ttaaaatgagagtttgatcctggctcaggataaacgctggcggcatgcctaatacatgcaagtcgaacggaggtgcttgcacctcagtggcgaacgggtgagtaacacgtatctaacctacctcatagcgggggataacttttggaaacgaaagataataccgcatgtagatcttattatcgcatgagaaaagatcaaaagaaccgtttggttcactatgagatggggatgcggcgtattagctagtaggtgagataatagcccacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataaagtaggaaatgactttatcttgacagtaccttaccagaaagccacggctaactatgtgccagcagccgcggtaatacataggtggcaagcgttatccggatttattgggcgtatagggtgcgtaggcggttttgcaagtttgaggttaaagtccggagctcaactccggttcgccttgaaaactgtattactagaatgcaagagaggtaagcggaattccgtgtgtagcggtgaaatgcgtagatatatggaagaacacctgtggcgaaagcggcttactggcttgttattgacgctgaggcacgaaagcgtggggagcaaataggattagataccctagtagtccacgccgtaaacgatgagtactaagtgttggggtaactcagcgctgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtagaggttaacattgagacaggtggtgcatggttgtcgtcagttcgtgccgtgaggtgttgggttaagtcccgcaacgaacgcaacccttgtcgttagttactaacattaagttgagaactctaacgagactgctagtgtaagctagaggaaggtggggatgacgtcaaatcatcatgccccttatgtcctgggctacacacgtgctacaatggctggtacaaagagttgcaatcctgtgaaggggagctaatctcaaaaaaccagtctcagttcggattgaagtctgcaactcgacttcatgaagccggaatcactagtaatcgcgaatcagctatgtcgcggtgaatacgttctcgggtcttgtacacaccgcccgtcacaccatgagagttggtaataccagaagtaggtagcttaaccgtttggagagcgcttcctaaggtaggactagcgattggggtgaagtcgtaacaaggtatccgtacgggaacgtgcggatggatcacctcctttctatgga

SEQ ID NO: 5938 - DNA, 1540 bp, Mycoplasma neurolyticum
  ref <308>: DATABASE ACCESSION NUMBER: NCBI ACCESSION: NZ_LR214951.1
  ref <309>: DATABASE ENTRY DATE: 2019-04-01
  ref <313>: RELEVANT RESIDUES IN SEQ ID NO: (1)..(1540)
aatttttgagagtttgatcctggctcaggatgaacgctggctgtgtgcctaatacatgcatgttgaacgaagcagtatttatattgacttagtagcgaatgggtgagtaacacgtacctaacctacctttaagattgggataactactggaaacagttgctaataccaaataacaaattttttcgcatgaaaaaattttaaaagaagcataagaggtaactccgcttcacttaaaaatgggggtgcggaacattagctagttggtagagtaatggcctaccaaggcgatgatgtttagccgggccgagaggctgtacggccacactgggactgagatacggcccagactcctacgggaggcagcagtagggaattttccacaatgagcgaaagcttgatggagcgacacagcgtgcaggatgaaggccttcgggttgtaaactgctgtggtaaggaaagaaaaaatagggtaggaaatgacccttaattgacggtaccttattagaaagcgatggctaactatgtgccagcagccgcggtaatacataggtcgcaagcgttatccggaattattgggcgtaaagagttcgtaggtggtttgttaagtctgaagttaaatccaaaagctcaacttttgcccgctttagatactagcaaactggaattgcaaagaggttagcggaattcctagtgaagcggtggaatgcgtagatattaggaagaacaccaataggcgaaggcagctaactggttgtatattgacactgaggaacgaaagcgtggggagcaaacaggattagataccctggtagtccacgccgtaaacgatgatcattagttggtagaaaaatttaccgatgcagctaacgcattaaatgatccgcctgagtagtatactcgcaagagtgaaacttaaaggaattgacggggacccgcacaagcggaggggcatgtggtttaatttgaagatacgcgtagaaccttacccactcttgacatcccttgcaaagttatagagatataatggaggctaacaaggtgacagatggtgcatggttgtcgtcagctcgtgtcgtgagatgttaggttaagtcctgcaacgagcgcaacccttgtctttagttactaacattaagttgagaactctagagagactgccaacgaaagttggaggaaggtggggacgacgtcaaatcatcatgcctcttacgagtggggcaacacacgtgctacaatggttggtacaaagagatgcgacatagtgatatcaagcaaatctcaaaaaaccaatctcagttcggattgaagtctgcaactcgacttcatgaagtcggattcgctagtaatcgcagatcagctatgctgcggtgaatacgttctcgggtcttgtacacaccgcccgtcacaccatgggagttggtaatacccgaagatggttagttaacctcggaggcaactatctaaggtaggactgatgactggggtgaagtcgtaacaaggtatccctacgagaacgtggggatggatcacctcctttcta

SEQ ID NO: 5939 - DNA, 1522 bp, Mycoplasma orale
  ref <308>: DATABASE ACCESSION NUMBER: NCBI ACCESSION: NZ_LR214940.1
  ref <309>: DATABASE ENTRY DATE: 2019-04-01
  ref <313>: RELEVANT RESIDUES IN SEQ ID NO: (1)..(1522)
aaattttaagagtttgatcctggctcaggatgaacgctggctgtgtgcctaatacatgcatgtcgagcggaagtagcaatactttagcggcgaatgggtgagtaacacgtgcttaatctaccttttagattggaatacctaatggaaacattggttaatgccggatacgcatgaagtcgcatgacttcgttgtgaaaggagcgtttgctccgctaagagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaacagttagttgaggaaatgcttctaatctgacggtaccttgttagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttagatagaggtaagcggaattccatgtggagcggtgaaatgcgtagatatatggaagaacaccaaaggcgaaggcagcttactgggtctatactgacgctgagggacgaaagcgtggggagcaaacaggattagataccctggtagtccacgctgtaaacgatgatcattagtcggtggaaaactactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatcccctgcaaagctatagagatatagtagaggttaacagggtgacagatggtgcatggttgtcgtcagctcgtgtcgtgagatgtttggtcaagtcctgcaacgagcgcaacccctatctttagttactaacgagtcatgtcgaggactctagagatactgcctgggtaaccgggaggaaggtggggatgacgtcaaatcatcatgcctcttacgagtggggctacacacgtgctacaatggtcggtacaaagagaagcaatatggcgacatggagcaaatctcaaaaagccgatctcagttcggattgaagtctgcaattcgacttcatgaagtcggaatcgctagtaatcgcagatcagctacgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtggggatggattacctcctttcta

SEQ ID NO: 5940 - DNA, 1513 bp, Mycoplasma penetrans
  ref <308>: DATABASE ACCESSION NUMBER: NCBI ACCESSION: NZ_RCHY01000003.1
  ref <309>: DATABASE ENTRY DATE: 2019-04-01
  ref <313>: RELEVANT RESIDUES IN SEQ ID NO: (1)..(1513)
ttttaagagtttgatcctggctcaggattaacgctagcgggatgcctaatacatgcaagtcggacgaagcacttgtgcttagtggcgaacgggtgagtaacatgtatctaacataccttttagtgggggataactggttgaaaaactagctaataccgcataggacattactatcgcatgagaaaatgtttaaagttgcgtttgcaacgctttaagattgaggtgcggcatatcagatagttggtagggtaacggcctaccaagtctatgacgtgtagctgtgctgagaggcaaaacagccacaatggaactgagacacggtccatacttctacgggaggcagcagtagggaatttttcacaatgggcgcaagcctgatggagcaatcccgcgtgaacgacgaaggttttttaaattgtaaagttcttttattggggacgaattgtaagaagaggaaatgctttttatttgactgtaccctttgaataagtatcggctaactatgtgccagcagccgcggtaatacataggatgcaagcgttatccggatttactgggcgtaaagcgagcgcaggcggatttacaagtctggtgttaaatatagctgcccaacagttatatgcattggaaactgtaagtctagagtgcagtagagagttttggaactccatgtggagcggtggaatgcgtagatatatggaagaacaccagaggcgaaggcgaaaacttaggctgttactgacgcttaggctcgaaagtgtggggagcaaataggattagataccctagtagtccacaccgtaaacgatggtaattaaatcttggtacgggatgtatcaggattgcagttaacacattaaattacccgcctgggtagtacattcgcaagaatgaaactcaaacggaattgacggggacccgcacaagtggtggagcatgttgcttaattcgacgatacacgtaaaaccttacctgggtttgacatcctctgcaaagctatagagatatagtggaggttaacagagtgacaggtggtgcatggttgtcgtcagctcgtgtcgtgagatgttgggttaagtcccgcaacgagcgcaacccttatcgttagttacttcatctagcgagactgccagcgtaagctggaggaaggtggggatgacgtcaaatcatcatgccctttatatccagggccgcaaacgtgctacaatggtcggtacaaactgttgccaatcagcaatgaggagctaatcagagaaagccgatctcagttcggatcgagggctgcaattcgtcctcgtgaagttggaatcactagtaatcgcaaatcagccatgttgcggtgaatacgttctcgggtcttgtacacaccgcccgtcaaactatgagagctggtaatacctaaaaccgttaagctaacctcgtgaggcttgcgtctagggtaggactggtaattggagttaagtcgtaacaaggtacccctacgggaatgtgggggtggatcacctcctttcta

SEQ ID NO: 5941 - DNA, 1531 bp, Mycoplasma phocicerebrale
  ref <308>: DATABASE ACCESSION NUMBER: NCBI ACCESSION: NZ_CP033058.1
  ref <309>: DATABASE ENTRY DATE: 2019-04-01
  ref <313>: RELEVANT RESIDUES IN SEQ ID NO: (1)..(1531)
aatttttaagagtttgatcctggctcaggatgaacgctggctgtgtgcctaatacatgcatgtcgagcgaggtttcttttgaagcctagcggcgaatgggtgagtaacacgtgcttaatctaccctttagattggaatacccaatggaaacattggctaatgccggatacgcatggaaccgcatggttccgttgtgaaaggagctttatagctccgctaaaggatgagggtgcggaacattagttagttggtagggtaatggcttaccaagactatgatgtttagccgtgtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttatagggaaagaacacttggttgaggaaatgcttccaagctgacggtaccctgtcagaaagcgatggctaactatgtgccagcagccgcggtaatacataggtcgcaagcgttatccggaattattgggcgtaaagcgttcgtaggctgtttattaagtctggagtcaaatcccggggctcaaccccggctcgctttggatactggtaaactagagttagatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgctgtaaacgatgatcattagtcggtggaggattcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtggaggttaacgaagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctacgctgcggtgaatacgttctcgggtcttgtacacaccgcccgtcacaccatgggagctggtaatacccaaagtcggtttgctaacctcggaggcgaccgcctaaggtaggactggtgactggggtgaagtcgtaacaaggtatccctacgagaacgtggggatggatcacctcctttctacgga

SEQ ID NO: 5942 - DNA, 1520 bp, Mycoplasma pneumoniae
  ref <308>: DATABASE ACCESSION NUMBER: NCBI ACCESSION: NZ_LR214945.1
  ref <309>: DATABASE ENTRY DATE: 2019-04-01
  ref <313>: RELEVANT RESIDUES IN SEQ ID NO: (1)..(1520)
tttttctgagagtttgatcctggctcaggattaacgctggcggcatgcctaatacatgcaagtcgatcgaaagtagtaatactttagaggcgaacgggtgagtaacacgtatccaatctaccttataatgggggataactagttgaaagactagctaataccgcataagaactttggttcgcatgaatcaaagttgaaaggacctgcaagggttcgttatttgatgagggtgcgccatatcagctagttggtggggtaacggcctaccaaggcaatgacgtgtagctatgctgagaagtagaatagccacaatgggactgagacacggcccatactcctacgggaggcagcagtagggaatttttcacaatgagcgaaagcttgatggagcaatgccgcgtgaacgatgaaggtctttaagattgtaaagttcttttatttgggaagaatgactttagcaggtaatggctagagtttgactgtaccattttgaataagtgacgactaactatgtgccagcagtcgcggtaatacataggtcgcaagcgttatccggatttattgggcgtaaagcaagcgcaggcggattgaaaagtctggtgttaaaggcagctgcttaacagttgtatgcattggaaactattaatctagagtgtggtagggagttttggaatttcatgtggagcggtgaaatgcgtagatatatgaaggaacaccagtggcgaaggcgaaaacttaggccattactgacgcttaggcttgaaagtgtggggagcaaataggattagataccctagtagtccacaccgtaaacgatagatactagctgtcggggcgatcccctcggtagtgaagttaacacattaagtatctcgcctgggtagtacattcgcaagaatgaaactcaaacggaattgacggggacccgcacaagtggtggagcatgttgcttaattcgacggtacacgaaaaaccttacctagacttgacatccttggcaaagttatggaaacataatggaggttaaccgagtgacaggtggtgcatggttgtcgtcagctcgtgtcgtgagatgttgggttaagtcccgcaacgagcgcaacccttatcgttagttacattgtctagcgagactgctaatgcaaattggaggaaggaagggatgacgtcaaatcatcatgccccttatgtctagggctgcaaacgtgctacaatggccaatacaaacagtcgccagcttgtaaaagtgagcaaatctgtaaagttggtctcagttcggattgagggctgcaattcgtcctcatgaagtcggaatcactagtaatcgcgaatcagctatgtcgcggtgaatacgttctcgggtcttgtacacaccgcccgtcaaactatgaaagctggtaatatttaaaaacgtgttgctaaccattaggaagcgcatgtcaaggatagcaccggtgattggagttaagtcgtaacaaggtacccctacgagaacgtgggggtggatcacctcctttcta

SEQ ID NO: 5943 - DNA, 1536 bp, Mycoplasma pulmonis
  ref <308>: DATABASE ACCESSION NUMBER: NCBI ACCESSION: NZ_LR215008.1
  ref <309>: DATABASE ENTRY DATE: 2019-04-01
  ref <313>: RELEVANT RESIDUES IN SEQ ID NO: (1)..(1536)
caatttttttgagagtttgatcctggctcaggatgaacgctggctgtgtgcctaatacatgcatgtcgagcggagtattaatttattagtgcttagcggcaaatgggtgagtaacacgtatttaacctacctcaaagactgggataacaacaggaaactgttgctaataccggatatgtatttagatcgcatgatttagatatcaaaggagcgtttgcttcactttgaaatgggagtgcgttacattagctagttggtagggtaatggcctaccaaggcgatgatgtatagctgagttgagagactgaacagccacactgggactgagatacggcccagactcctacgggaggcagcagtagggaattttccacaatggacgaaagtctgatggagtgacacagcgtgcaggatgaaggtcttcggattgtaaactgctgttataagggaagaaaagcttagggaggaaatgccctaagtatgacggtaccttgtcagaaagcaccggctaactatgtgccagcagccgcggtaatacatagggtgcaagcgttatccgaaattattgggtgtaaagagttcgtaggttgtttgttaagtcagaagttaaatcccggggctcaaccctggcccgcttttgatactagcaaactagagttataaagaggttagtggaattcctagtgaagcggtgaaatgtgtagatattaggaagaacatcaatggcgaaggcagctaactggttatgtactgacactgaggaacgaaagcgtggggagcaaacaggattagataccctggtagtccacgccgtaaacgatgatcattagctggtggaatttttcactagcgcagctaacgcattaaatgatccacctgagtagtatgctcgcaagagtgaaacttaaaggaattgacggggacccgcacaagcggtggagcatgtggtttaatttgacgatacgcgtagaaccttacccactcttgacatccttcgcaaagctatagagatatagtggaggttaacggagtgacagatggtgcatggttgtcgtcagctcgtgtcgtgagatgttcggttaagtcctgcaacgagcgcaacccctatctttaattactacattaagttgaggactttaaagatactgaccaagcaattggtaggaaggtggggatgacgtcaaatcatcatgcctcttacgagtggggcaacacacgtgctacaatggccggtacaaagagaagcaagatggtgacatggagcaaatctcaaaaaaccggtctcagttcggattgaagtctgcaactcgacttcatgaagttggaatcgctagtaatcgtagatcagctacgctacggtgaatacgttctcgggtcttgtacacaccgcccgtcacaccatgggagctggtaatgcccaaagtcggtttagctaacctcggaggcgactgtctaaggcaggactggtgactggggtgaagtcgtaacaaggtatccctacgagaacgtggggatggatcacctcctttctacgga

SEQ ID NO: 5944 - DNA, 1531 bp, Mycoplasma putrefaciens
  ref <308>: DATABASE ACCESSION NUMBER: NCBI ACCESSION: NZ_LS991954.1
  ref <309>: DATABASE ENTRY DATE: 2019-04-01
  ref <313>: RELEVANT RESIDUES IN SEQ ID NO: (1)..(1531)
ttaaaatgagagtttgatcctggctcaggataaacgctggcggcatgcctaatacatgcaagtcgaacgggggtgcttgcaccccagtggcgaacgggtgagtaacacgtatctaacctaccttatagcgggggataacttttggaaacgaaagataataccgcatgtgaatcttattatcgcatgagaaaagattgaaagaaccgtttggttcactatgagatggggatgcggcgtattagctagtaggtgaggtaatggctcacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataaagtaggaaatgcctttatattgacggtaccttaccagaaagccacggctaactatgtgccagcagccgcggtaatacataggtggcaagcgttatccggatttattgggcgtatagggtgcgtaggcggttgtgcaagtttgaggttaaagtccggagctcaactccggttcgccttgaaaactgcattactagaatacaagagaggtaagcggaattccatgtgtagcggtgaaatgcgtagatatatggaagaacacctgtggcgaaagcggcttactggtttgttattgacgctgaggcacgaaagcgtggggagcaaataggattagataccctagtagtccacgccgtaaacgatgagtactaggtgttgggtgaactcagcgccgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtagaggttaacattgagacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggctggtacaaagagtcgcaatctcgcgagggggagctaatctcaaaaaaccagtctcagttcggattgaagtctgcaacttgacttcatgaagccggaatcactagtaatcgcgaatcagctatgtcgcggtgaatacgttctcgggtcttgtacacaccgcccgtcacaccacgagagttggtaataccagaagtgggtagcttaaccgcaaggagagcgcctcccaaggtaggactagcgattggggtgaagtcgtaacaaggtatccgtacgggaacgtgcggatggatcacctcctttctatgga

SEQ ID NO: 5945 - DNA, 1531 bp, Mycoplasma salivarium
  ref <308>: DATABASE ACCESSION NUMBER: NCBI ACCESSION: NZ_LR214938.1
  ref <309>: DATABASE ENTRY DATE: 2019-04-01
  ref <313>: RELEVANT RESIDUES IN SEQ ID NO: (1)..(1531)
ttaaaatgagagtttgatcctggctcaggataaacgctggcggcatgcctaatacatgcaagttgaacgggggtgcttgcacctcagtggcgaacgggtgagtaacacgtatctaacctaccttatagcgggggataacttttggaaacgaaagataataccgcatgtagatcttattatcgcatgagaaaagatcaaaagaaccgtttggttcactatgagatggggatgcggcgtattagctagtaggtgagataatagcccacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataaagtaggaaatgactttatcttgacagtaccttaccagaaagccacggctaactatgtgccagcagccgcggtaatacataggtggcaagcgttatccggatttattgggcgtatagggtgcgtaggcggttttgcaagtttgaggttaaagtccggagctcaactccggttcgccttgaaaactgttttactagaatgcaagagaggtaagcggaattccatgtgtagcggtgaaatgcgtagatatatggaagaacacctgtggcgaaagcggcttactggcttgttattgacgctgaggcacgaaagcgtggggagcaaataggattagataccctagtagtccacgccgtaaacgatgagtactaagtgttggggtaactcagcgctgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtagaggttaacattgagacaggtggtgcatggttgtcgtcagttcgtgccgtgaggtgttgggttaagtcccgcaacgaacgcaacccttgtcgttagttactaacattaagttgagaactctaacgagactgctagtgtaagctagaggaaggtggggatgacgtcaaatcatcatgccccttatgtcctgggctacacacgtgctacaatggctggtacaaagagttgcaatcctgtgaaggggagctaatctcaaaaaaccagtctcagttcggattgaagtctgcaactcgacttcatgaagccggaatcactagtaatcgcgaatcagctatgtcgcggtgaatacgttctcgggtcttgtacacaccgcccgtcacaccatgagagttggtaataccagaagtaggtagcttaaccatttggagagcgcttcccaaggtaggactagcgattggggtgaagtcgtaacaaggtatccgtacgggaacgtgcggatggatcacctcctttctatgga

SEQ ID NO: 5946 - DNA, 1524 bp, Mycoplasma sp. 237IA
  ref <308>: DATABASE ACCESSION NUMBER: NCBI ACCESSION: NZ_CP034044.1
  ref <309>: DATABASE ENTRY DATE: 2019-04-01
  ref <313>: RELEVANT RESIDUES IN SEQ ID NO: (1)..(1524)
aatttttaagagtttgatcctggctcaggatgaacgctggctgtgtgcctaatacatgcatgtcgagcggggttttttaaacctagcggcgaatgggtgagtaacacgtgcttaatctaccttttagattggaatacctgatggaaacattagttaatgccggatacgcatggaatcgcatgattccgttgtgaaaggggcctcaaagccccactaagagatgagggtgcggaacattagttagttggtagggtaatggcctaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttataagggaagaacattcagaagaggaaatgcttttgaactgacggtaccttatcagaaagcgatggctaactatgtgccagcagccgcggtaatacataggtcgcaagcgttatccggaattattgggcgtaaagcgttcgtaggctgtttgttaagtctggagtcaaatcccggggctcaaccccggctcgctttggatactggcaaactagagttggatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgctgtaaacgatgatcattagtcggtggggaactcactgacgcagctaacgcattaaatgatccgcctgagtagtatgctcgcaagagtgaaacttaaaggaattgacggggacccgcacaagcggtggagcatgtggtttaatttgaagatacacggagaaccttacccactcttgacatcttctgcaaagctatagagatatagtggaggttaacagaatgacagatggtgcatggttgtcgtcagctcgtgtcgtgagatgtttggtcaagtcctgcaacgagcgcaacccctatctttagttactaacgagttaagtcgaggactctagagatactgcctgggtaaccgggaggaaggtggggatgacgtcaaatcatcatgcctcttacgagtggggccacacacgtgctacaatggtcggtacaaagagaagcaatatggcgacattgagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgaccgcctaaggtaggactggtgactggggtgaagtcgtaacaaggtatccctacgagaacgtggggatggatcacctcctttcta

SEQ ID NO: 5947 - DNA, 1526 bp, Mycoplasma sp. ATU-Cv-703
  ref <308>: DATABASE ACCESSION NUMBER: NCBI ACCESSION: NZ_RYZV01000001.1
  ref <309>: DATABASE ENTRY DATE: 2019-04-01
  ref <313>: RELEVANT RESIDUES IN SEQ ID NO: (1)..(1526)
aatttttaacgagagtttgatcctggctcaggatgaacgctggctgtgtgcctaatgcatgcatgtcgtgcgaagtacttgtacttagcggcaaatgggtgagtaacacgtacctaacctacctttaggattgggataactggaggaaactccggctaataccggatatgttattgtctcgcatgagactttaatcaaaggagcgtttgctccgcctagagatgggggtgcgctacattaggtagttggtagggtaaaagcctaccaagccgatgatgtatagcggggttgagaagctgatccgccacactaggattgagatacggcctagacttctacggaaggcagcagcagggaattttccacaatgagcgaaagcttgatggagcgacacagcgtgcaggatgaaggtcttaggattgtaaactgctgttgtgagggaagaacagccggaagaggaaatgcttccggtttgacggtacctcaccagaaagcaccggcaaactatgtgccagcagtcgcggtaatacatagggtgcaagcgttatccggatttattgggcgtaaagcgttcgtaggtggtatgttaagtctagagttaaagcctaaagctcaactttagtccgctttggatactagcatactagagtcatgaagaggttagtggaactccatgtgaagcggtggaatgcgtagatatatggaagaacaccaatggcgaaggcaactaactggtcatgtacagacactgagggacgaaagcgtggggagcaaataggattagataccctagtagtccacgccgtaaacgatgctcgttagttggtggcagagtcactagcgcagttaacacgttaaacgagccgcctgagtagtatgctcgcaagagtgaaacttaaaggaattgacggggacccgcacaagcggtggagcatgtggtttaattcgaagctacgcgaagaaccttacccactcttgacatccttggcaatgctatagagatatagcggaggttaaccaagtgacaggtggtgcatggctgtcgtcagctcgtgtcgtgagatgttaggttaagtcctgtaacgagcgcaaccctcatccttagttactaacatttagttgagcactctagggagaccgccggggtaacccggaggaaggcgaggacgacgtcaggtcatcatgcctcttacgagtggggcgacacacgtgctacaatggcaagtacaaagagaagcaatacggtgacgtggagcaaaactggaaaacttgtctcagttcggattgaagtctgcaactcgacttcatgaagtcggaatcgctagtaatcgtaggtcagacatactacggtgaatacgttctcgggtcttgtacacaccgcccgtcacaccatgggagttggtaatacccaaagtcggtagattaacttcggagatcgccgcctaaggtaggactgatgactggggtgaagtcgtaacaaggtatccctacgagaacgtggggatggatcacctcctttctacgga

SEQ ID NO: 5948 - DNA, 1522 bp, Mycoplasma subdolum
  ref <308>: DATABASE ACCESSION NUMBER: NCBI ACCESSION: NZ_REFI01000005.1
  ref <309>: DATABASE ENTRY DATE: 2019-04-01
  ref <313>: RELEVANT RESIDUES IN SEQ ID NO: (1)..(1522)
attattaagagtttgatcctggctcaggatgaacgctggctgtgtgcctaatacatgcatgtcgagcggaagtagcaatactttagcggcgaatgggtgagtaacacgtgcttaatctacctcttagattggaatatccaatggaaacattggttaatgccggatacgcatggaatcgcatgattccgttgtgaaaggggcgtttgccccgctaagagatgagggtgcggaacattagctagttggtagggtaatggcctaccaaggctatgatgtttagccgggtcgagagactgaacggccacattgggactgagatacggcccaaactcctacgggaggcagcagtagggaatattccacaatgagcgaaagcttgatggagcgacacagtgtgaacgatgacggccttcgggttgtaaagttctgttgtgagggaagaacacttggcttaggaaatgaggccaagctgacggtaccttattagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttagatagaggtaagcggaattccatgtgaagcggtgaaatgcgtagatatatggaagaacaccaaaggcgaaggcagcttactgggtttatactgacgctgagggacgaaagcgtggggagcaaacaggattagataccctggtagtccacgccgtaaacgatgatcattagtcggtggagcattcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtggaggttaacggagtgacagatggtgcatggttgtcgtcagctcgtgtcgtgagatgtttggtcaagtcctgcaacgagcgcaacccctgtctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatacggtgacgtggagcaaatctcaaaaagccgatctcagttcggattgaagtctgcaactcgacttcatgaagtcggaatcgctagtaatcgcagatcagctacgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtggggatggatcacctcctttcta

SEQ ID NO: 5949 - DNA, 1506 bp, Mycoplasma synoviae
  ref <308>: DATABASE ACCESSION NUMBER: NCBI ACCESSION: NZ_LS991953.1
  ref <309>: DATABASE ENTRY DATE: 2019-04-01
  ref <313>: RELEVANT RESIDUES IN SEQ ID NO: (1)..(1506)
ttttgagagtttgatcctggctcaggatgaacgctggctgtgtgcctaatacatgcatgtcgagcggaatttagcaataaatttagcggcgaatgggtgagtaacacgtacttaacgtaccttttagactggaataacggtgagaaattatcgctaatgccggatatataaaaaaatcgcatgatttttttaagaaagaagcgtttgcttcactaagagatcggggtgcggaacattagctagttggtagggtaatggcctaccaaggcaattatgtttagcggggttgagagactgaaccgccacactgggactgagatacggcccagactcctacgggaggcagcagtagggaattttccacaatgggcgaaagcctgatggagcaacacagcgtgtaggatgaaggccttcgggttgtaaactactgttatatgggaagaaaaactagtataggaaatgatattagcttgacggtaccatgtcagaaagcaacggctaactatgtgccagcagccgcggtaatacataggttgcaagcgttatccggaattattgggcgtaaagcgtctgtaggttgtttgttaagtctggtgttaaaacttggagctcaactccaaattgcattggatactggcagactagaattgtttagaggttagcggaattccttgtgaagcggtggaatgcgtagatataaggaagaacaccaacatggcgaaggcagctaactgggaacatattgacactgagagacgaaagcgtggggagcaaacaggattagataccctggtagtccacgctgtaaacgatgatgactagttgatggaaaccatcgacgcagctaacgcattaagtcatccgcctgagtagtatgctcgcaagagtgaaacttaaaggaattgacggggatccgcacaagcggtggagcatgtggtttaatttgaagatacgcgtagaaccttacccactcttgacatcttctgcaaagctatagagatatagtggaggttaacagaatgacagatggtgcatggttgtcgtcagctcgtgtcgtgagatgttcggttaagtcctgcaacgagcgcaacccttgtccttagttactttatctaaggagactgcccgagtaattgggaggaaggtggggacgacgtcaaatcatcatgcctcttacgagtggggcaacacacgtgctacaatggacgatacaaagagaagcaaaatagtgatatcaagcaaatctcaaaaaatcgttctcagttcggattgtagtctgcaactcgactacatgaagtcggaatcgctagtaatcgtagatcagctacgctacggtgaatacgttctcgggtcttgtacacaccgcccgtcacaccatgggagctggtaatgcccgaagtcggtttgttaacttcggagacgactgcctaaggcaggaccggtgactggggtgaagtcgtaacaaggtatccctacgagaacgtggggatggattacctcctttct

SEQ ID NO: 5950 - DNA, 1544 bp, Myxococcus macrosporus
  ref <308>: DATABASE ACCESSION NUMBER: NCBI ACCESSION: NZ_CP022203.1
  ref <309>: DATABASE ENTRY DATE: 2019-04-01
  ref <313>: RELEVANT RESIDUES IN SEQ ID NO: (1)..(1544)
ttcaattggagagtttgatcctggctcagaacgaacgctggcggcgtgcctaacacatgcaagtcgagcgcgaataggggcaacccttagtagagcggcgcacgggtgcgtaacacgtggataatctgcctgagtgctcgggataaccagtcgaaagattggctaataccggataagcccacggtttcttcggagactgagggaaaaggtggcctctgtatacaagctatcacattcagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggaagaaaacccgttggctaacatccaacggcttgacggtaccgggagaagaagcaccggctaactctgtgccagcagccgcggtaatacagagggtgcaagcgttgttcggaattattgggcgtaaagcgcgtgtaggcggcgtgacaagtcgggtgtgaaagccctcagctcaactgaggaagtgcgcccgaaactgtcgtgcttgagtgccggagagggtggcggaattccccaagtagaggtgaaattcgtagatatggggaggaacaccggtggcgaaggcggccacctggacggtaactgacgctgagacgcgaaagcgtggggagcaaacaggattagataccctggtagtccacgccgtaaacgatgagaactaggtgtcgtgggagttgacccccgcggtgccgaagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgttgccaacccgcgagggggagctaatcgcataaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagaggtgcccaaggagtggtcggtaactggggtgaagtcgtaacaaggtagccgtaggggaacctgcggctggatcacctcctttctaa

SEQ ID NO: 5951 - DNA, 1495 bp, Myxosarcina sp. GI1
  ref <308>: DATABASE ACCESSION NUMBER: NCBI ACCESSION: NZ_JRFE01000014.1
  ref <309>: DATABASE ENTRY DATE: 2019-04-01
  ref <313>: RELEVANT RESIDUES IN SEQ ID NO: (1)..(1495)
catggagagtttgatcctggctcaggatgaacgctggcggtatgcctaacacatgcaagtcgaacgctcttttataagagagtggcggacgggtgagtaacgcgtgagaatctgccttcaggatggggacaacagttggaaacgactgctaatacccaatatgcccttaggggtgaaatgtatttcgcctgaagaggagctcgcgtccgattagctagttggtggggtaagagcctaccaaggcagcgatcggtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttctcaaggaagaagcaagtgacggtacttgaggaatcagcatcggctaactccgtgccagcagccgcggtaatacggaggatgcaagcgttatccgaaatcattgggcgtaaagcgtccgcaggtggcatatcaagtctgctgtcaaagactagagctcaactctggaaaggcagtggaaactggtaagctagagtacggtaggggttgagggaattcccagtgtagcggtgaaatgcgtagatattgggaagaacaccagtggcgaaggcgctcaactgggccgtaactgacactcagggacgaaagctagggtagcgaaagggattagatacccctgtagtcttagctgtaaacgatggatactaggcgttgcttgtatcgacccgagcagtgccgtagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaacctgctggaaacagtggggtgccttcgggagccggaacacaggtggtgcatggctgtcgtcagctcgtgtcgtgagatgttgggttaagtcccgcaacgagcgcaaccctcgtccttagttgccagcattaagatgggcactttagggagactgccggtgacaaaccggaggaaggtggggatgacgtcaagtcagcatgccccttacgtcctgggctacacacgtactacaatggttgggacaaagggcagctaactcgcaagagcaagcgaatctcagcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagtcggccacgcccgaagtcgttaccctaacctttcgaggagggggatgccgaaggcagggctggtgactggggtgaagtcgtaacaaggtagccgtaccggaaggtgtggctggatcacctccttaaaggg

SEQ ID NO: 5952 - DNA, 1527 bp, Nafulsella turpanensis
  ref <308>: DATABASE ACCESSION NUMBER: NCBI ACCESSION: NZ_ANNU01000014.1
  ref <309>: DATABASE ENTRY DATE: 2019-04-01
  ref <313>: RELEVANT RESIDUES IN SEQ ID NO: (1)..(1527)
tacaatggagagtttgatcctggctcaggatgaacgctagcggcaggcctaatacatgcaagtcgaacggtaggtacctttcggggtactgagagtggcgcacgggtgcgtaacgcgtatgcaacttaccctttaccgggggatagcccggggaaacccggattaataccccatggcattgcaccttcgcatggaggagcaattaaagatttattggtagaggatgggcatgcgtgccattagctagttggtagggtaacggcctaccaaggcgacgatggctagggggtctgagaggatgatcccccacactggcactgagacacgggccagactcctacgggaggcagcagtagggaatattggtcaatggaggagactctgaaccagccatgccgcgtgcaggatgaaggcgttatgcgttgtaaactgcttttatataggaagaaaaagggagtgcgctcctatctgacggtactatatgaataagcaccggctaactccgtgccagcagccgcggtaatacggagggtgcaagcgttgtccggatttattgggtttaaagggtgcgtaggcggataattaagtcagtggtgaaagccgacagctcaactgtcgaaccgccattgatactggttgtcttgagtgtagttgaggcaggcggaatttacgatgtagcggtgaaatgcatagatatcgtaaagaacacctatagcgaaggcagcttgctaagctactactgacgctgaggcacgaaagcatggggagcgaacaggattagataccctggtagtccatgccgtaaacgatgattactcgatgttggcgatattactgtcagcgtccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgcccttgaccggtccagagatggactctcccttcggggcaaggtgcaaggtgctgcatggccgtcgtcagctcgtgccgtgaggtgttgggttaagtcccgcaacgagcgcaacccctattcttagttgccagcacataatggtggggactctaagaagactgcctgcgcaagcagagaggaaggaggggatgacgtcaggtcatcatggcccttacgcccagggctacacacgtgctacaatggtgcatacaaagggttgcaagctggtgacagcaagccaatctcaaaaagtgcatctcagttcggattggagtctgcaactcgactccatgaagttggaatcgctagtaatcgcgcatcagcaacggcgcggtgaatacgttcccggaccttgtacacaccgcccgtcaagccatgggaatcgggaggacctgaagacggttgctgttaaggcgctgtcaagggttaaactggtgactggggctaagtcgtaacaaggtagccgtaccggaaggtgcggctggaacacctcctttctgga

SEQ ID NO: 5953 - DNA, 1081 bp, Nakamurella silvestris
  ref <308>: DATABASE ACCESSION NUMBER: NCBI ACCESSION: NZ_QXCQ01000108.1
  ref <309>: DATABASE ENTRY DATE: 2019-04-01
  ref <313>: RELEVANT RESIDUES IN SEQ ID NO: (1)..(1081)
tttaactgaagagtttgatcatggctcagattgaacgctggcggcaggcttaacacatgcaagtcgagcgggggaggttgcttcggtaactgacctagcggcggacgggtgagtaatacttaggaatctgcctattaatgggggacaacatctcgaaagggatgctaataccgcatacgccctacgggggaaagcaggggatcacttgtgaccttgcgttaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctcttttggttaatacccaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggtctttgagactttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgaga

SEQ ID NO: 5954 - DNA, 1523 bp, Nakamurella sp. 12Sc4-1
  ref <308>: DATABASE ACCESSION NUMBER: NCBI ACCESSION: NZ_QCXS01000006.1
  ref <309>: DATABASE ENTRY DATE: 2019-04-01
  ref <313>: RELEVANT RESIDUES IN SEQ ID NO: (1)..(1523)
ttggagagtttgatcctggctcaggacgaacgctggcggcgtgcttaacacatgcaagtcgaacggaaaggcccgcttgcgggtactcgagtggcgaacgggtgagtaacacgtgggcaacctgccctcagctttgggataactcccggaaacgggtgctaataccgaatattgacttgtcctcgcatgggggtttgttgaaagttttttcggctggggatgggcccgcggcctatcagcttgttggtggggtgatggcctaccaaggcgacgacgggtagccggcctgagagggcgatcggccacactggaactgagacacggtccagactcctacgggaggcagcagtggggaatattgcgcaatgggcggaagcctgacgcagcgacgccgcgtgagggatgaaggtcttcggattgtaaacctctttcagtagggacgaatagaagacggtacctgcagaagaagcaccggccaactacgtgccagcagccgcggtaatacgtagggtgcgagcgttgtccggaattattgggcgtaaagagctcgtaggcggttcgtcgcgtcgaatgtgaaatcccggggctcaactccgggtctgcattcgatacgggcggactagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggcgctaggtgtgggggacttccacgttctctgtgccgcagctaacgcattaagcgccccgcctggggagtacggccgcaaggctaaaactcaaaggaattgacgggggcccgcacaagcggcggagcatgctgattaattcgatgcaacgcgaagaaccttaccaaggcttgacatacaccggaaacttccagaaatggttgccccgcaaggtcggtgtacaggtggtgcatggttgtcgtcagctcgtgtcgtgagatgttgggttaagtcccgcaacgagcgcaaccctcgtcttatgttgccagcacgtcatggtggggactcataagagactgccggggtcaactcggaggaaggtggggatgaggtcaaatcatcatgccccttatgtcttgggcttcaagcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggtaacacccgaagccggtggcccaacccgtaagggagggagctgtcgaaggtgggatcggcgattgggacgaagtcgtaacaaggtagccgtaccggaaggtgcggctggatcacctcctttctaaggagca

SEQ ID NO: 5955 - DNA, 1526 bp, Nakamurella sp. s14-144
  ref <308>: DATABASE ACCESSION NUMBER: NCBI ACCESSION: NZ_CP034170.1
  ref <309>: DATABASE ENTRY DATE: 2019-04-01
  ref <313>: RELEVANT RESIDUES IN SEQ ID NO: (1)..(1526)
tcaatggagagtttgatcctggctcaggacgaacgctggcggcgtgcttaacacatgcaagtcgaacggaaaggcccgcttgcgggtactcgagtggcgaacgggtgagtaacacgtgggcaacctgccctcagctttgggataacacaaagaaatttgtgctaataccggataataaacggccgcgcatgtggttgttttgaaagtttttcggctggggatgggcccgcggcctatcagcttgttggtggggtaatggcctaccaaggcgacgacgggtagccggcctgagagggcgaccggccacactggaactgagacacggtccagactcctacgggaggcagcagtggggaatattgcgcaatgggcggaagcctgacgcagcgacgccgcgtgagggatgaaggtcttcggattgtaaacctctttcagcagggacgaagcgcaagtgacggtacctgcagaagaagcaccggccaactacgtgccagcagccgcggtaatacgtagggtgcaagcgttgtccggaattattgggcgtaaagagctcgtaggcggtttgtcgcgtcgaatgtgaaagcccggggctcaactccgggtctgcattcgatacgggcaaactagagttcggtaggggagtctggaattcctggtgtagcggtgaaatgcgcagatatcaggaggaacaccggtggcgaaggcgggactctgggccgatactgacgctgaggagcgaaagcgtggggagcgaacaggattagataccctggtagtccacgccgtaaacggtgggcgctaggtgtgggggacttccacgttctctgtgccgcagctaacgcattaagcgccccgcctggggagtacggccgcaaggctaaaactcaaaggaattgacgggggcccgcacaagcggcggagcatgctgattaattcgatgcaacgcgaagaaccttaccaaggcttgacatgtacaggaaagttccagaaatggttctcccgcaaggtctgtatacaggtggtgcatggttgtcgtcagctcgtgtcgtgagatgttgggttaagtcccgcaacgagcgcaaccctcgtcttatgttgccagcacgtgatggtggggactcataagagactgccggggtcaactcggaggaaggtggggatgaggtcaaatcatcatgccccttatgtcttgggcttcaagcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggtaacacccgaagccggtggcctaaccccttgtgggagggagctgtcgaaggtgggatcggcgattgggacgaagtcgtaacaaggtagccgtaccggaaggtgcggctggatcacctcctttctaaggag

SEQ ID NO: 5956 - DNA, 1543 bp, Natranaerobius thermophilus
  ref <308>: DATABASE ACCESSION NUMBER: NCBI ACCESSION: NC_010718.1
  ref <309>: DATABASE ENTRY DATE: 2019-04-01
  ref <313>: RELEVANT RESIDUES IN SEQ ID NO: (1)..(1543)
ggagggtttgatcctggctcaggacgaacgctggcggcgtgcctaacacatgcaagtcgagcgaacccttcgggtcaatggcttcggtcattgacccggtcagggttagcggcggacgggtgagtaacacgtggataacctaccccggagaccgggataacaggccgaaaggcctgctaataccggataaacttcatagtgcgcatgtactgtgaagtaaaagggttcaaccgctctgggatgggtccgcgtcccattagctagttggtgaggtaacagctcaccaaggcgacgatgggtagccgaccttagcgggtgatcggccacactgggactgagacacggcccagactcctacgggaggcagcagtggggaatcttgcgcaatgggcgaaagcctgacgcagcgacgccgcgtgagcgaagaaggccttcgggtcgtaaagctctgtcgagggggaagaactcagacggtacccctcaagcaagccccggctaactacgtgccagcagccgcggtaacacgtagggggcgagcgttgtccggaattactgggcgtaaagggcgcgcaggcggccctgcaagtcagatgtgaaactccggggctcaactccggacttgcatttgaaactgtagggcttgagtgcaggagaggggagtggaattcccggtgtagcggtgaaatgcgtagatatcgggaggaacaccagtggcgaaagcgactccctggcctgcaactgacgctgaggcgcgaaagcgtgggtagcaaacaggattagataccctggtagtccacgctgtaaacgctgggtactaggtgttgggggtttagataccctcagtgccgcagctaacgcattaagtaccccgcctggggagtacggtcgcaagactgaaactcaaaggaattgacgggggcccgcacaagcggtggagcatgtggtttaattcgaagcaacgcggagaaccttaccagggcttgacatacaggcgatgggtgtagagatacaccttcccttcggggcgcttgtacaggtggtgcatggctgtcgtcagctcgtgtcgtgagatgttgggttaagtcccgtaacgagcgcaacccctgtccttagttgccatcggttcggccgggcactctagggagactgccggtgacaaaccggaggaaggtggggatgacgtcaagtcctcatgccccttatgccctgggctacacacgtgctacaatggcctgtacagagggaagctaagccgtgaggtggagctaacccctcaaagcaggtcccagttcggattgtaggctgcaattcgcctgcatgaagctggaatcgctagtaatcgcggatcagaatgccgcggtgaatacgttcccgggccttgtacacaccgcccgtcacaccacgaaagccggcaacacccgaagccagtgcagccaacccttttggggaggcagctgtcgaaggtggggccggtgattggggtgaagtcgtaacaaggtagccgtatcggaaggtgcggctggatcacctcctttctagggag

SEQ ID NO: 5957 - DNA, 555 bp, Natribacillus halophilus
  ref <308>: DATABASE ACCESSION NUMBER: NCBI ACCESSION: NZ_FNEN01000015.1
  ref <309>: DATABASE ENTRY DATE: 2019-04-01
  ref <313>: RELEVANT RESIDUES IN SEQ ID NO: (1)..(555)
tttatggagagtttgatcctggctcaggacgaacgctggcggcgtgcctaatacatgcaagtcgaacggtctagaggtgagagttgagaggtgagaagtgagctgtcgtagacatcggcagagccgatgtcacctaaatcccacttcccatttcccacctctcacttctagacagtggcggccgggtgagtaacacgtgggcaacctgccgcggagactggaataacaccgggaaaccggtgctaataccggatatgtccctgcctgcgcctgcaggcggggagaaaggcggtcttttgaccgccactccgcgaggggcccgcggcgcattagctggttggtggggtaaaagcctaccaaggcgacgatgcgtcgccgacctgagagggtgatcggccacactgggactgagacacggcccagactcctacgggaggcagcagtagggaatcatccgcaatggacgaaagtctgacggtgcaacgccgcgtgagtgaggaaggttttcggatcgtaaagctctgttgtgagggaagaaccccttcgggcggaaat

SEQ ID NO: 5958 - DNA, 1469 bp, Natronohydrobacter thiooxidans
  ref <308>: DATABASE ACCESSION NUMBER: NCBI ACCESSION: NZ_MJAP01000025.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgaacgaaggcttcggccttagtggcggacgggtgagtaacgcgtgggaacgtgccctttgctacggaacagtcctgggaaactgggtttaataccgtatgtgcccttcgggggaaagaatttcggcaaaggatcggcccgcgttggattaggtagttggtggggtaaaggcctaccaagccgacgatccatagctggtttgagaggatgatcagccacactgggactgagacacggcccagactcctacgggaggcagcagtggggaatcttagacaatgggggcaaccctgatctagccatgccgcgtgatcgatgaaggccttagggttgtaaagatctttcgctggggaagataatgacggtacccagtaaagaagccccggctaactccgtgccagcagccgcggtaatacggagggggctagcgttgttcggaattactgggcgtaaagcgcgcgtaggcggattggaaagttgggggtgaaatcccggggctcaaccccggaactgcctccaaaactatcagtctggagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagacgtcggcaggcatgcctgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcggctctggagacagggctttcagttcggctggatatcacacaggtgctgcatggctgtcgtcagctcgtgtcgtgagatgttcggttaagtccggcaacgagcgcaacccacgtccttagttgccagcattgagttgggcactctaaggaaactgccgatgataagtcggaggaaggtgtggatgacgtcaagtcctcatggcccttacgggttgggctacacacgtgctacaatggtggtgacagtgggataatccccaaaagccatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaagatggtgcgctaactcagcaatgagaggcagccagccacggtaggctcagcgactggggtgaagtcgtaacaaggtagccgtaggggaacctgcggctggatcacctcctttcta

SEQ ID NO: 5959 - DNA, 1465 bp, Nautella sp. ECSMB14104
  ref <308>: DATABASE ACCESSION NUMBER: NCBI ACCESSION: NZ_LAUK01000030.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcgcccttcggggtgagcggcggacgggttagtaacgcgtgggaacgtgcccagatctaaggaatagccactggaaacggtgagtaataccttatacgcccttcgggggaaagatttatcggatttggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggattagtcagttagaggtgaaatcccagggctcaaccctggaactgcctttaatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggctttcacttcggtgaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 5960 - DNA, 1507 bp, Nautilia profundicola
  ref <308>: DATABASE ACCESSION NUMBER: NCBI ACCESSION: NZ_CP026530.1
  ref <309>: DATABASE ENTRY DATE: 2019-04-01
  ref <313>: RELEVANT RESIDUES IN SEQ ID NO: (1)..(1507)
ttaatggagagtttgatcctggctcagagtgaacgctggcggcatgcttaacacatgcaagtcgaggggcagcaggcgggaacttcggttcccgtgctggcgaccggcggacgggtgagtaacacgtagctacttgccccacagagggggataacacaccgaaaggtgtgctaataccgcatacacccgagaggggaaagggcttcggtccgctgtgggatagggctgcggcgtatcagctagttggtgaggtaacggcttaccaaggcgatgacgcgtagctggtctgagaggatgatcagccacactggaactgagacacggtccagactcctacgggaggcagcagtggggaatattgggcaatgggggaaaccctgacccagcaatgccgcgtggaggaagaagcctttcggggtgtaaactccttttgcaggggaagaaactgacggtaccctgcgaataagctccggctaactccgtgccagcagccgcggtaatacggggggagcgagcgttactcggaatcactgggcgtaaagggtgcgtaggcggtcagataagttgggagtgaaatcctatggctcaaccatagaactgcttccaaaactgtctgactagagttcgggagaggccaagggaattcctggtgtaggggtgaaatccgtagagatcaggaggaatgccgaaagcgaaggcgcttggctggaacgaaactgacgctgaggcacgaaagcgtggggagcaaacaggattagataccctggtagtccacgccctaaacgatgggtactagtggttggggggacagtcccccagtcacgcagcaaacgcgataagtaccccgcctggggagtacggccgcaaggctaaaactcaaaggaatagacggggacccgaacaagcggtggagcatgtggtttaattcgaagatacgcgaagaaccttacctgggcttgacatccacggaaccctgcagagatgcgggggtgctacttcggtagagccgtgagacaggtgctgcatggctgtcgtcagctcgtgtcgtgagatgttgggttaagtcccgcaacgagcgcaacccctgtccttagttggcatcagttcggctggccactctaaggagactgcccgggcaaccgggaggaaggtggggatgacgtcaagtcatcatggcccttatgtccagggcgacacacgtgctacaatggccgggacagagagakgcgaaaccgcgaggtggagcaaatctctaaacccggtctcagttcggattgcactctgcaactcgagtgcatgaaggcggaatcgctagtaatcgcggatcagccatgccgcggtgaatacgttcccgggtcttgtactcaccgcccgtcacaccatgggagtcgggttcacccgaagtcggtatccctaagayaggggccgcctacggtggacccggcgactggggtgaagtcgtaacaaggtagccgtaggagaacctgcggctggatcacctcctttc

SEQ ID NO: 5961 - DNA, 1569 bp, Negativibacillus sp. 1xD8-3
  ref <308>: DATABASE ACCESSION NUMBER: NCBI ACCESSION: NZ_RAYL01000086.1
  ref <309>: DATABASE ENTRY DATE: 2019-04-01
  ref <313>: RELEVANT RESIDUES IN SEQ ID NO: (1)..(1569)
tttttggagagtttgatcttggctcaggacgaacgctggcggcgtgcctaatacatgcaagtcgagcgcgggaagcaagcagaactccttcgggagtgacgcttgtggaacgagcggcggacgggtgagtaacacgtgggcaacctacctgtaagactgggataactccgggaaaccggggctaataccggatgatacatgtcgtcgcatgacgagatgttaaaaaggcggcatatgctgtcacttacagatgggcctgcggcgcattagctagttggtgagataaaagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactgggggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacgcccctagagatagggagttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 5962 - DNA, 1563 bp, Negativicoccus massiliensis
  ref <308>: DATABASE ACCESSION NUMBER: NCBI ACCESSION: NZ_LT700188.1
  ref <309>: DATABASE ENTRY DATE: 2019-04-01
  ref <313>: RELEVANT RESIDUES IN SEQ ID NO: (1)..(1563)
atggagagtttgatcctggctcaggacgaacgctggcggcgtgcctaacacatgcaagtcgaacggagagatacgagagcttgctcttgtaaatcttagtggcgaacgggtgagtaacgcgtaaacaacctgcccaacggatggggacaacagacggaaacgactgctaatacccaatagactccggtttcgcatgaaaccgacaggaaaggtggcctctcgaagaagctaccgccgcaggaggggtttgcgtttgattagttagttggtggggtaacggcctaccaagacgatgatcaatagccggtctgagaggatgaacggccacactggaactgagacacggtccagactcctacgggaggcagcagtggggaatcttccgcaatggacgcaagtctgacggagcaacgccgcgtgagtgaagacggccttcgggttgtaaagctctgttattcgggaagaacgattcgtttgtgaacaatgaacggaagtgacggtaccgaaagagaaagccacggctaactacgtgccagcagccgcggtaatacgtaggtggcaagcgttgtccggaattattgggcgtaaagagcgcgtaggcggtatggtaagtctgtcttagaagtgcggggcttaaccccgtgaggggacagagactgtcatactggagtctcggagaggaaagcggaattcctagtgtagcggtgaaatgcgtagagattaggaagaacaccggtggcgaaggcggctttctggacgagcactgacgctgaggcgcgaaagcgtggggagcgaacaggattagataccctggtagtccacgccgtaaacgatgggtactaggtgtaggaggtatcgaccccttctgtgccggagttaacgcaataagtaccccgcctggggagtacggtcgcaagattaaaactcaaaggaattgacgggggcccgcacaagcggtggagtatgtggtttaattcgacgcaacgcgaagaaccttaccaggtcttgacattgatcgccatccgcagagacgcggagttctccttcgggagacgagaaaacaggtggtgcacggctgtcgtcagctcgtgtcgtgagatgttgggttaagtcccgcaacgagcgcaacccctatcttcaattaccagcacgtcatggtggggactatggagagactgccgatgacaaatcggaggaaggcggggatgacgtcaagtcatcatgccccttatgacctgggctacacacgtactacaatggtcctgacagagagcagcgaagtggcgacaccaagcgaacctcagaaacaggatcccagttcggatcgcaggctgcaactcgcctgcgtgaagcaggaatcgctagtaatcgcgggtcagcataccgcggtgaatacgttcccgggccttgtacacaccgcccgtcacaccacgagagtggggaacacccgaagccggtgggagaaccgaaaggactcagccgtcgaaggtgggcttcatgattggggtgaagtcgtaacaaggtagccgtaccggaaggtgcggctggatcacctcctttcta

SEQ ID NO: 5963 - DNA, 1520 bp, Neglecta sp. Marseille-P3890
  ref <308>: DATABASE ACCESSION NUMBER: NCBI ACCESSION: NZ_FZLO01000011.1
  ref <309>: DATABASE ENTRY DATE: 2019-04-01
  ref <313>: RELEVANT RESIDUES IN SEQ ID NO: (1)..(1520)
ttttagagagtttgatcctggctcaggacgaacgctggcggcgtgcctaacacatgcaagtcgaacggagttaagagaagcttgcttttattaacttagtggcggacgggtgagtaacgcgtgagcaatctgcctttcagtggggaataacgttctgaaaagaacgctaataccgcataatattgttgagccgcatggtttgataatcaaaggatttattcgctgaaagatgagctcgcgtccgattagatagttggtgaggtaacggctcaccaagtcgacgatcggtagccggactgagaggttgaacggccacattgggactgagacacggcccagactcctacgggaggcagcagtgagggatattggtcaatgggggaaaccctgaaccagcaacgccgcgtgagggaagacggttttcggattgtaaacctctgtcctctgtgaagataatgacggtagcagaggaggaagctccggctaactacgtgccagcagccgcggtaatacgtagggagcaagcgttgtccggatttactgggtgtaaagggtgcgtaggcggctatgcaagtcaggagtgaaatctatgggcttaacccataaactgctcttgaaactgtatagcttgagtgaagtagaggtaggcggaattcccggtgtagcggtggaatgcgtagagatcgggaggaacaccagtggcgaaggcggcctactgggctttaactgacgctgaagcacgaaagcgtgggtagcaaacaggattagataccctggtagtccacgccgtaaacgatgattactaggtgtggggggtctgaccccctccgtgccggagttaacacaataagtaatccacctggggagtacggtcgcaagactgaaactcaaaggaattgacgggggcccgcacaagcagtggagtatgtggattaattcgaagcaacgcgaagaaccttaccaggtcttgacatccctctgaccgctctagagatagagcttctcttcggagcagaggtgacaggtggtgcatggttgtcgtcagctcgtgtcgtgagatgttgggttaagtcccgcaacgagcgcaacccctatgattagttgctacgcaagagcactctaatcagactgccgttgacaaaacggaggaaggtggggatgacgtcaaatcatcatgccccttatgacctgggcctcacacgtactacaatggccgttaacaacgggatgcaatatagcgatatggagcaaaaccccaaaaacggtctcagttcggattgtaggctgaaactcgcctgcatgaagctggaattgctagtaatcgcagatcagaatgctgcggtgaatacgttcccgggccttgtacacaccgcccgtcacaccatgggagccggtaatacccgaagtcagtagcctaaccgtaaggagggcgctgccgaaggtagggttggcgactggggtgaagtcgtaacaaggtagccgtatcggaaggtgcggctggatcacctcctttctatgga

SEQ ID NO: 5964 - DNA, 1546 bp, Neisseria animalis
  ref <308>: DATABASE ACCESSION NUMBER: NCBI ACCESSION: NZ_LR134287.1
  ref <309>: DATABASE ENTRY DATE: 2019-04-01
  ref <313>: RELEVANT RESIDUES IN SEQ ID NO: (1)..(1546)
attgaacataagagtttgatcctggctcagattgaacgctggcggcatgctttacacatgcaagtcggacggcagcggggaagtgcttgcacttctgccggcgagtggcgaacgggtgagtaacatattggaacgtaccgagtaatgggggataactgatcgaaagattagctaataccgcatacgctctgaggaggaaagcaggggaccttcgggccttgcgttattcgagcggccaatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggagatgctaataccatttcctcatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagtccgcttaccacggtatgcttcatgactggggtgaagtcgtaacaaggtagccgtaggggaacctgcggctggatcacctcctttct

SEQ ID NO: 5965 - DNA, 1548 bp, Neisseria animaloris
  ref <308>: DATABASE ACCESSION NUMBER: NCBI ACCESSION: NZ_LR134516.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcgaacggcagcacggaagagcttgctcttttggtggcgagtggcgaacgggtgagtaatacatcggaacgtaccgagtagtgggggataactgtccgaaaggatggctaataccgcatattctctgaggaggaaagcaggggaccttcgggccttgcgctatttgagcggccgatgtctgattagctagttggtggggtaaaggcctaccaaggcgacgatcagtagcgggtctgagaggatgatccgccacactgggactgagacacggcccagactcctacgggaggcagcagtggggaattttggacaatggggggaaccctgatccagccatgccgcgtgtctgaagaaggccttcgggttgtaaaggacttttgtcagggaagaaaagcttgaggttaatacccttgagtgatgacggtacctgaagaataagcaccggctaactacgtgccagcagccgcggtaatacgtagggtgcgagcgttaatcggaattactgggcgtaaagcgggcgcagacggttacttaagtcagatgtgaaatccccgggctcaacctgggaactgcgtttgaaactgggtgactagagtatgtcagaggggggtagaattccacgtgtagcagtgaaatgcgtagagatgtggaggaataccgatggcgaaggcagccccctgggataatactgacgttcatgcccgaaagcgtgggtagcaaacaggattagataccctggtagtccacgccctaaacgatgtcaattagctgttggggcacttgatgccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgtaaggagcccgtttaccacggtatgcttcatgactggggtgaagtcgtaacaaggtagccgtaggggaacctgcggctggatcacctcctttctag

SEQ ID NO: 5966 - DNA, 1548 bp, Neisseria bergeri
  ref <308>: DATABASE ACCESSION NUMBER: NCBI ACCESSION: NZ_QQKO01000012.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagggaagcttgcttctcgggtggcgagtggcgaacgggtgagtaacatatcggaacgtaccgagtagtgggggataactgatcgaaagatcagctaataccgcatacgtcttgagagggaaagcaggggaccttcgggccttgcgctattcgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaacatcggcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccgcaaggggtccgcttaccacggtatgcttcatgactggggtgaagtcgtaacaaggtagccgtaggggaacctgcggctggatcacctcctttctag

SEQ ID NO: 5967 - DNA, 1548 bp, Neisseria canis
  ref <308>: DATABASE ACCESSION NUMBER: NCBI ACCESSION: NZ_LR134313.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcgaacggcagcacggaagagcttgctcttttggtggcgagtggcgaacgggtgagtaatgcatcggaacgtaccgagtagtgggggataactgtccgaaaggatggctaataccgcatacgctttgagaaggaaagcaggggatcttcggaccttgcgctattcgagcggccgatgtctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagctttgggttaataccctggagtgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtggctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttggggcacttgatgccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctag

SEQ ID NO: 5968 - DNA, 1548 bp, Neisseria cinerea
  ref <308>: DATABASE ACCESSION NUMBER: NCBI ACCESSION: NZ_LS483369.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagggaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgttcagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggaaccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccgcaaggggtccgcttaccacggtatgcttcatgactggggtgaagtcgtaacaaggtagccgtaggggaacctgcggctggatcacctcctttctag

SEQ ID NO: 5969 - DNA, 1548 bp, Neisseria dumasiana
  ref <308>: DATABASE ACCESSION NUMBER: NCBI ACCESSION: NZ_MTAB01000057.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacaaagaagcttgcttcttgggtggcgagtggcgaacgggtgagtaacgcatcggaacgtaccgagtagtgggggataactgtccgaaaggatggctaataccgcatacgctttgagaaggaaagcgggggatcttcggacctcgcgctattcgagcggccgatgtctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagcttgaggctaatacccttgagtgatgacggtacctgaagaataagcaccggctaactacgtgccagcagccgcggtaatacgtagggtgcgagcgttaatcggaattactgggcgtaaagcgggcgcagacggttacttaagtcagatgtgaaatccccgggctcaacctgggaactgcgtttgaaactgggtagctagagtatgtcagaggggggtagaattccacgtgtagcagtgaaatgcgtagagatgtggaggaataccgatggcgaaggcagccccctgggataatactgacgttcatgcccgaaagcgtgggtagcaaacaggattagataccctggtagtccacgccctaaacgatgtcaattagctgttggggcacttgatgccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatcccacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctag

SEQ ID NO: 5970 - DNA, 1548 bp, Neisseria gonorrhoeae
  ref <308>: DATABASE ACCESSION NUMBER: NCBI ACCESSION: NZ_LR134358.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagggaagcttgcttctcgggtggcgagtggcgaacgggtgagtaacatatcggaacgtaccgggtagcgggggataactgatcgaaagatcagctaataccgcatacgtcttgagagggaaagcaggggaccttcgggccttgcgctatccgagcggccgatatctgattagctggttggcggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggccgttgccaatatcggcggccgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtggaattccacgtgtagcagtgaaatgcgtagagatgtggaggaataccgatggcgaaggcagcctcctgggataacactgacgttcatgtccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggttttgacatgtgcggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcggttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctag

SEQ ID NO: 5971 - DNA, 1546 bp, Neisseria macacae
  ref <308>: DATABASE ACCESSION NUMBER: NCBI ACCESSION: NZ_OAEH01000114.1
  ref <309>: DATABASE ENTRY DATE: 2019-04-01
  ref <313>: RELEVANT RESIDUES IN SEQ ID NO: (1)..(1546)
attgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagagaaagcaggggactttcgggccttgcgctattcgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaataccagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttct

SEQ ID NO: 5972 - DNA, 1548 bp, Neisseria meningitidis
  ref <308>: DATABASE ACCESSION NUMBER: NCBI ACCESSION: NZ_LR134526.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagattagctaataccgcatacgtcttgagagagaaagcaggggacctttgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagtccgcttaccacggtatgcttcatgactggggtgaagtcgtaacaaggtagccgtaggggaacctgcggctggatcacctcctttctag

SEQ ID NO: 5973 - DNA, 1546 bp, Neisseria polysaccharea
  ref <308>: DATABASE ACCESSION NUMBER: NCBI ACCESSION: NZ_OABN01000107.1
  ref <309>: DATABASE ENTRY DATE: 2019-04-01
  ref <313>: RELEVANT RESIDUES IN SEQ ID NO: (1)..(1546)
attgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggactttcgggccttgcgctattcgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaataccagcggccgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttct

SEQ ID NO: 5974 - DNA, 1548 bp, Neisseria sicca
  ref <308>: DATABASE ACCESSION NUMBER: NCBI ACCESSION: NZ_OADK01000093.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagagaaagcaggggactttcgggccttgcgctattcgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccgcaaggagtccgcttaccacggtatgcttcatgactggggtgaagtcgtaacaaggtagccgtaggggaacctgcggctggatcacctcctttctag

SEQ ID NO: 5975 - DNA, 1311 bp, Neisseria sp. 10009
  ref <308>: DATABASE ACCESSION NUMBER: NCBI ACCESSION: NZ_RPFL01000085.1
  ref <309>: DATABASE ENTRY DATE: 2019-04-01
  ref <313>: RELEVANT RESIDUES IN SEQ ID NO: (1)..(1311)
gatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcagttgctaatatcagctgctgatgacggtacctgaagaataagcaccggctaactacgtgccagcagccgcggtaatacgtagggtgcgagcgttaatcggaattactgggcgtaaagcgagcgcagacggttagttaagcaagatgtgaaatccccgggctcaacctgggaactgcgttttgaactggctggctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgtaaggagcccgtttaccacggtatgcttcatgactggggtgaagtcgtaacaaggtagccgtaggggaacctgcggctggatcacctcctttctag

SEQ ID NO: 5976 - DNA, 1264 bp, Neisseria sp. 10010
  ref <308>: DATABASE ACCESSION NUMBER: NCBI ACCESSION: NZ_RKIL01000033.1
  ref <309>: DATABASE ENTRY DATE: 2019-04-01
  ref <313>: RELEVANT RESIDUES IN SEQ ID NO: (1)..(1264)
agtgggggataactgtccgaaaggatggctaataccgcatacgctttgagaaggaaagcgggggatcgcaagacctcgcgctattcgagcggccgatgtctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaagggtttgggctaataccccgggcatatgacggtacctgaagaataagcaccggctaactacgtgccagcagccgcggtaatacgtagggtgcgagcgttaatcggaattactgggcgtaaagcgggcgcagacggttcgttaagcaagatgtgaaatccccgggctcaacctgggaactgcgttttgaactggcggactagagtgtgtcagaggggggtagaattccacgtgtagcagtgaaatgcgtagagatgtggaggaataccgatggcgaaggcagccccctgggatgacactgacgttcatgcccgaaagcgtgggtagcaaacaggattagataccctggtagtccacgccctaaacgatgtcaattagctgttggggcacttgatgccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatccttcggagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccg

SEQ ID NO: 5977 - DNA, 1418 bp, Neisseria sp. 10011
  ref <308>: DATABASE ACCESSION NUMBER: NCBI ACCESSION: NZ_RPFM01000093.1
  ref <309>: DATABASE ENTRY DATE: 2019-04-01
  ref <313>: RELEVANT RESIDUES IN SEQ ID NO: (1)..(1418)
aaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtagtgggggataactaatcgaaagattagctaataccgcatattctctaaggaggaaagccggggaccttcgggcctggcgctatttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcagttgctaatatcagctgctgatgacggtacctgaagaataagcaccggctaactacgtgccagcagccgcggtaatacgtagggtgcgagcgttaatcggaattactgggcgtaaagcgagcgcagacggttagttaagcaagatgtgaaatccccgggctcaacctgggaactgcgttttgaactggctggctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggag

SEQ ID NO: 5978 - DNA, 1551 bp, Neisseria sp. 10022
  ref <308>: DATABASE ACCESSION NUMBER: NCBI ACCESSION: NZ_CP023429.1
  ref <309>: DATABASE ENTRY DATE: 2019-04-01
  ref <313>: RELEVANT RESIDUES IN SEQ ID NO: (1)..(1551)
agagattaaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtagtgggggataactaatcgaaagattagctaataccgcatattctctaaggaggaaagccggggaccttcgggcctggcgctatttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcagttgctaatatcagctgctgatgacggtacctgaagaataagcaccggctaactacgtgccagcagccgcggtaatacgtagggtgcgagcgttaatcggaattactgggcgtaaagcgagcgcagacggttagttaagcaagatgtgaaatccccgggctcaacctgggaactgcgttttgaactggctggctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgtaaggagcccgtttaccacggtatgcttcatgactggggtgaagtcgtaacaaggtagccgtaggggaacctgcggctggatcacctcctttcta

SEQ ID NO: 5979 - DNA, 1546 bp, Neisseria sp. N177 16
  ref <308>: DATABASE ACCESSION NUMBER: NCBI ACCESSION: NZ_PHTC01000080.1
  ref <309>: DATABASE ENTRY DATE: 2019-04-01
  ref <313>: RELEVANT RESIDUES IN SEQ ID NO: (1)..(1546)
attaaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtagtgggggataactaatcgaaagattagctaataccgcatattctctgaggaggaaagctggggaccttcgggcctagcgctatttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtatgaagaaggccttcgggttgtaaagtacttttgtcagggaagaaaagcatagtgctaatatcactgtgtgatgacggtacctgaagaataagcaccggctaactacgtgccagcagccgcggtaatacgtagggtgcgagcgttaatcggaattactgggcgtaaagcgagcgcagacggttagttaagcaagatgtgaaatccccgggctcaacctgggaactgcgttttgaactggctagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggaaccgtaacacaggtgctgcatggctgtcgtcagctcgtgtcgtgagatgttgggttaagtcccgcaacgagcgcaacccttgtcattagttgccatcattcagttgggcactctaatgatactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgtaaggagcccgtttaccacggtatgcttcatgactggggtgaagtcgtaacaaggtagccgtaggggaacctgcggctggatcacctcctttct

SEQ ID NO: 5980 - DNA, 1546 bp, Neisseria sp. N95 16
  ref <308>: DATABASE ACCESSION NUMBER: NCBI ACCESSION: NZ_PDBT02000104.1
  ref <309>: DATABASE ENTRY DATE: 2019-04-01
  ref <313>: RELEVANT RESIDUES IN SEQ ID NO: (1)..(1546)
attaaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtagtgggggataactaatcgaaagattagctaataccgcatattctctgaggaggaaagctggggaccttcgggcctagcgctatttgagcggccgatatctgattagctrgttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtatgaagaaggccttcgggttgtaaagtacttttgtcagggaagaaaagcatagtgctaatatcactgtgtgatgacggtacctgaagaataagcaccggctaactacgtgccagcagccgcggtaatacgtagggtgcgagcgttaatcggaattactgggcgtaaagcgagcgcagacggttagttaagcaagatgtgaaatccccgggcttaacctgggaactgcgttttgaactggctagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggaaccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgtaaggagcccgtttaccacggtatgcttcatgactggggtgaagtcgtaacaaggtagccgtaggggaacctgcggctggatcacctcctttct

SEQ ID NO: 5981 - DNA, 1548 bp, Neisseria wadsworthii
  ref <308>: DATABASE ACCESSION NUMBER: NCBI ACCESSION: NZ_POXA01000036.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcgaacggcagcacggaagagcttgctcttttggtggcgagtggcgaacgggtgagtaatgcatcggaacgtaccgagtagtgggggataactgtccgaaaggatggctaataccgcatacgctttgcgaaggaaagcgggggctcttcggacctcgcgctattcgagcggccgatgtctgattagctagttggtggggtaaaggcctaccaaggcgacgatcagtagcgggtctgagaggatgatccgccacactgggactgagacacggcccagactcctacgggaggcagcagtggggaattttggacaatggggggaaccctgatccagccatgccgcgtgtctgaagaaggccttcgggttgtaaaggacttttgtcagggaagaaaagcttcgggttaataccctggagtgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttggggcacttgatgccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctag

SEQ ID NO: 5982 - DNA, 1548 bp, Neisseria weaveri
  ref <308>: DATABASE ACCESSION NUMBER: NCBI ACCESSION: NZ_LR134533.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcacagagaagcttgcttcttgggtggcgagtggcgaacgggtgagtaatatattggaacgtaccgagtaatgggggataacttgccgaaaggtaagctaataccgcatacgctctgaggaggaaagcaggggaccttcgggccttgcgttattcgagcggccaatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggttgtggctaatatccatgactgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctag

SEQ ID NO: 5983 - DNA, 1532 bp, Neisseriaceae bacterium DSM 100970
  ref <308>: DATABASE ACCESSION NUMBER: NCBI ACCESSION: NZ_CP024847.1
  ref <309>: DATABASE ENTRY DATE: 2019-04-01
  ref <313>: RELEVANT RESIDUES IN SEQ ID NO: (1)..(1532)
aaacaaaagagtttgatcctggctcagattgaacgctggcggcgtgctttacacatgcaagtcgagcggcagcacgaccttcgggttggtggcgagcggcgaacgggtgagtaatacatcggaacgtaccttttagtgggggataacgcatcgaaagatgtgctaataccgcataatctctgaggaggaaaggcggggaccttcgggcctgtcgctgaaagagcggccgatggctgattagctagttggtagggtaaaggcctaccaaggcgatgatcagtagctgttctgagaggaagatcagccacactgggactgagacacggcccagactcctacgggaggcagcagtggggaattttggacaatggggggaaccctgatccagcaacgccgcgtgaatgaagaaggccttcgggttgtaaagttcttttgtcagggagcaaagggtagatgctaataccatctatcgctgagagtacctgaagaataagcaccggctaactacgtgccagcagccgcggtaatacgtagggtgcaagcgttaatcggaattactgggcgtaaagcgtgcgcaggcggatgattaagttaggagtgaaatccccgggctcaacctgggaactgcttttaagactggtcatctagagtttgtcagaggggggtggaattccaagtgtagcagtgaaatgcgtagagatttggaggaacaccgatggcgaaggcagccccctgggataaaactgacgctcatgcacgaaagcgtgggtagcaaacaggattagataccctggtagtccacgccctaaacgatgtttacttgctgttgggggcaaccttagtagcgaagctaacgcgagaagtaaaccgcctggggagtacggtcgcaagattaaaactcaaaggaattgacggggacccgcacaagcggtggatgatgtggattaattcgatgcaacgcgaaaaaccttacctgctcttgacatgtacggaagatttcagagatgagattgtgccttcgggaaccgtaacacaggtgctgcatggctgtcgtcagctcgtgtcgtgagatgttgtcttaagtgacgcaacgagcgcaacccttgtcactagttgccatcattaagttgggcactttagtgagactgccggagctaatccggaggaaggtggggatgacgtcaagtcctcatggcccttatgagcagggcttcacacgtcatacaatggtaagtacagagggaagcgaagcggcgacgtggagcaaatctcataaaacttatcgtagtccggatcgtagtctgcaactcgactacgtgaagtcggaatcgctagtaatcgcagatcagcatgctgcggtgaatacgttcccgggtcttgtacacaccgcccgtcacaccatgggagtggaggataccagaagtagttaggctaaccgcaagggggccgattaccacggtatgtttcatgactggggtgaagtcgtaacaaggtagcagtaggggaacctgcggctggatcacctcctttct

SEQ ID NO: 5984 - DNA, 1494 bp, Neoasaia chiangmaiensis
  ref <308>: DATABASE ACCESSION NUMBER: NCBI ACCESSION: NZ_CP014691.1
  ref <309>: DATABASE ENTRY DATE: 2019-04-01
  ref <313>: RELEVANT RESIDUES IN SEQ ID NO: (1)..(1494)
tgaacctgagagtttgatcctggctcagagcgaacgctggcggcatgcttaacacatgcaagtcgcacggacctttcggggtgagtggcggacgggtgagtaacgcgtagggatttatccacgggtgggggataacactgggaaactggtgctaataccgcatgatgcctgagggccaaaggcgtaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaattactgggcgtaaagggcgcgtaggcggttgtgacagtcagatgtgaaattcctgggcttaacctgggggctgcatttgatacgtgacgactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggaaacttagtttttcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgtccagagatgggcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctagaggaactgccggtgacaagccggaggaaggtggggatgacgtcaagtcctcatggcccttatgtcctgggctacacacgtgctacaatggcggtgacagtgggaagctagacagtgatgtcatgctgatctctaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggttcgaccttaagctggtgagcgaaccgcaaggacgcagccaaccacggtcgggttagcgactagggtgaagtcgtaacaaggtagccgtaggggaacctgcggctggatcacctcctttcaag

SEQ ID NO: 5985 - DNA, 1534 bp, Neobitarella massiliensis
  ref <308>: DATABASE ACCESSION NUMBER: NCBI ACCESSION: NZ_OKQO01000019.1
  ref <309>: DATABASE ENTRY DATE: 2019-04-01
  ref <313>: RELEVANT RESIDUES IN SEQ ID NO: (1)..(1534)
tgataaagagtttgatcctggctcaggacgaacgctggcggcgcgcttaacacatgcaagtcgaacggacacatccgacggaatagcttgctaggaagatggatgttgttagtggcggacgggtgagtaacacgtgagcaacctacctcagagtgggggacaacagttggaaacgactgctaataccgcataagatggcagggtcgcatggcctggtcataaaaggagcaattcgctctgagatgggctcgcgtctgattagctagttggtgaggtaacggctcaccaaggcaacgatcagtagccggactgagaggttgaacggccacattgggactgagacacggcccagactcctacgggaggcagcagtggggaatattgcacaatgggggaaaccctgatgcagcgacgccgcgtgagggaagacggttttcggattgtaaacctctgtcttgtgggacgatagtgacggtaccacaggaggaagccatggctaactacgtgccagcagccgcggtaatacgtagatggcgagcgttgtccggaattactgggtgtaaagggagtgtaggcgggctggtaagttgaatgtgaaaccttcgggctcaacccggagcgtgcgttcaaaactgctggtcttgagtgaagtagaggcaggcggaattcccggtgtagcggtggaatgcgtagatatcgggaggaacaccagtggcgaaggcggcctgctgggcttttactgacgctgaggctcgaaagcatgggtagcaaacaggattagataccctggtagtccatgccgtaaacgatgattactaggtgtggggggattgaccccctccgtgccggagttaacacaataagtaatccacctggggagtacgaccgcaaggttgaaactcaaaggaattgacgggggcccgcacaagcagtggagtatgtggtttaattcgaagcaacgcgaaaaaccttaccaggtcttgacatccatcgccaggctaagagattagctgttcccttcggggacgatgagacaggtggtgcatggttgtcgtcagctcgtgtcgtgagatgttgggttaagtcccgcaacgagcgcaacccttactattagttgctacgcaagagcactctaatgggactgccgttgacaaaacggaggaaggtggggatgacgtcaaatcatcatgccccttatgacctgggctacacacgtactacaatggccgttaacagagagcagcgataccgcgaggtggagcgaatctagaaaaacggtctcagttcggattgcaggctgaaactcgcctgcatgaagtcggaattgctagtaatcgcggatcagcatgccgcggtgaatacgttcccgggccttgtacacaccgcccgtcacaccatgagagccggtaacacccgaagtcagtagcctaaccgcaaggagggcgctgccgaaggtggggctggtaattggggtgaagtcgtaacaaggtagccgtatcggaaggtgcggctggatcacctcctttctaaggaa

SEQ ID NO: 5986 - DNA, 1551 bp, Neochlamydia sp. EPS4
  ref <308>: DATABASE ACCESSION NUMBER: NCBI ACCESSION: NZ_JSDQ01000106.1
  ref <309>: DATABASE ENTRY DATE: 2019-04-01
  ref <313>: RELEVANT RESIDUES IN SEQ ID NO: (1)..(1551)
ttttcttgagaatttgatcttggttcagattgaatgctgacagcgtggatgaggcatgcaagtcgaacgaaatgtagcaatacatttagtggcggaagggttagtaatacatgggtaacttaccattaacttgggaataacgattggaaacgatcgctaataccgaatgtggtgataacaaggcatcttgaaatcattaaagtgggggatcttcggacctcgcggttaaagagaggcccatgggatatcagctagttggtagggtaaaggcctaccaaggctaagacgtctaggcggattgagagattgaccgccaacactgggactgagaactgcccagactcctacgggaggctgcagtcgagaatctttcgcaatgggcgaaagcctgacgaagcgacgctgtgtgagtgatgaaggccttcgggtcgtaaaactctttcgcctgggaacaaggggatctagctaacatctagagaacttgagcgtaccaggtaaagaagcaccggctaactccgtgccagcagctgcggtaatacggagggtgcaagcattaatcggatttattgggcgtaaagggcgcgtaggcgggaaggaaagtcagatgtgaaatcccggggctcaacctcggaacagcatttgaaacttcctttcttgagggtagacggagaaaatggaattccacaagtagcggtgaaatgcgtagatatgtggaagaacaccagtggcgaaggcgattttctagtttacacctgacgctgaggcgcgaaagcaaggggatcaaacaggattagataccctggtagtccttgccgtaaacgatgtatacttggtgtaaccggaatcaaccctggttgtgccgaagctaacgcgataagtataccgcctgaggagtacgctcgcaagggtgaaactcaaaagaattgacggggacccgcacaagcagtggagcatgtggtttaattcgatgcaacgcgaagaaccttacccaggcttgacatgcagatgatcattacagagatgtaatttcccttcggggcatctgcacaggtgctgcatggctgtcgtcagctcgtgccgtgaggtgtttggttaagtccagcaacgagcgcaacccttatcattagttgccaacactttgggtgggaactctaatgagactgcctgggttaaccaggaggaaggtgaggatgacgtcaagtccgcatggcccttatgtctggggctacacacgtgctacaatggtcggtacagaaggcagcgaagccgcgaggtgaagcaaatcctaaaagccgatctcagttcagattgtagtctgcaactcgactacatgaagacggaattgctagtaatggtgggtcagcaacaccaccgtgaatacgttcccgggtcttgtacacaccgcccgtcacatcatgggagttggttttacccgaagccgctggctcaaccgcaaggagagaggcgtctaaggtgaggctgatgactgggatgaagtcgtaacaaggtagccctaccggaaggtggggctggatcacctccttttaagga

SEQ ID NO: 5987 - DNA, 1551 bp, Neochlamydia sp. S13; identical to SEQ ID NO: 5986
  ref <308>: DATABASE ACCESSION NUMBER: NCBI ACCESSION: NZ_BASK01001240.1
  ref <309>: DATABASE ENTRY DATE: 2019-04-01
  ref <313>: RELEVANT RESIDUES IN SEQ ID NO: (1)..(1551)

SEQ ID NO: 5988 - DNA, 1551 bp, Neochlamydia sp. TUME1; identical to SEQ ID NO: 5986
  ref <308>: DATABASE ACCESSION NUMBER: NCBI ACCESSION: NZ_JRXI01000224.1
  ref <309>: DATABASE ENTRY DATE: 2019-04-01
  ref <313>: RELEVANT RESIDUES IN SEQ ID NO: (1)..(1551)

SEQ ID NO: 5989 - DNA, 1391 bp, Neokomagataea thailandica
  ref <308>: DATABASE ACCESSION NUMBER: NCBI ACCESSION: NZ_BCZB01000063.1
  ref <309>: DATABASE ENTRY DATE: 2019-04-01
  ref <313>: RELEVANT RESIDUES IN SEQ ID NO: (1)..(1391)
gtaacgcgtaggtatctatccatgggtgggggataacattgggaaactggtgctaataccgcatgacacctgagggtcaaaggcgcaagtcgcctgtggaggagcctgcgttcgattagctagttggttgggtaatggctgaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgttggggacgatgatgacggtacccaaagaagaagccccggctaacttcgtgccagcagccgcggtaatacgaagggggctagcgttgctcggaatgactgggcgtaaagggcgcgtaggcggtttaagcagtcagatgtgaaatccccgggcttaacctgggaactgcatttgagacgcttagactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttaggtaacttagttacttagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtagtcagagatgactatttcttcggacctcccgcacaggtgctgcatggctgtcgtcagctcgtgtcgtgagatgttgggttaagtcccgcaacgagcgcaacccttgtctttagttgccatcaggttgggctgggcactctagagagactgccggtgacaagccggaggaaggtggggatgacgtcaagtcctcatggcccttatgtcctgggctacacacgtgctacaatggcggtgacagtgggaagctatgtggtgacacagtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgtaaggacgcagccgaccacggacgggtcagcgactggggtgaagtcgtaacaaggtagccgtaggggaacctgcggctggatcacctcctttcaagg

SEQ ID NO: 5990 - DNA, 1481 bp, Neorhizobium alkalisoli
  ref <308>: DATABASE ACCESSION NUMBER: NCBI ACCESSION: NZ_PVBN01000026.1
  ref <309>: DATABASE ENTRY DATE: 2019-04-01
  ref <313>: RELEVANT RESIDUES IN SEQ ID NO: (1)..(1481)
caacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 5991 - DNA, 1492 bp, Neorhizobium galegae
  ref <308>: DATABASE ACCESSION NUMBER: NCBI ACCESSION: NZ_CCRJ01000042.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgcctcgcaagaggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggacagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 5992 - DNA, 1481 bp, Neorhizobium huautlense
  ref <308>: DATABASE ACCESSION NUMBER: NCBI ACCESSION: NZ_PVBM01000062.1
  ref <309>: DATABASE ENTRY DATE: 2019-04-01
  ref <313>: RELEVANT RESIDUES IN SEQ ID NO: (1)..(1481)
caacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagccacagagatgtggtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 5993 - DNA, 1484 bp, Neorhizobium sp. NCHU2750
  ref <308>: DATABASE ACCESSION NUMBER: NCBI ACCESSION: NZ_CP030827.1
  ref <309>: DATABASE ENTRY DATE: 2019-04-01
  ref <313>: RELEVANT RESIDUES IN SEQ ID NO: (1)..(1484)
caacttgagagtttgatcctggctcagaacgaacgctggcggcaggcttaacacatgcaagtcgagcgcctcgcaagaggagcggcagacgggtgagtaacacgtgggaacgtaccctttactacggaacaactccgggaaactggagctaataccgtatacgcccttagggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggttagtggaattgcgagtgtagaggtgaaattcgtagatattcgcaggaacaccagtggcgaaggcggctaactggtccataactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctcgccacagagatgtggttttcccttcggggaccggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggggtgaccctgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttcta

SEQ ID NO: 5994 - DNA, 1482 bp, Neorhizobium sp. SOG26
  ref <308>: DATABASE ACCESSION NUMBER: NCBI ACCESSION: NZ_CP025512.1
  ref <309>: DATABASE ENTRY DATE: 2019-04-01
  ref <313>: RELEVANT RESIDUES IN SEQ ID NO: (1)..(1482)
tcaacttgagagtttgatcctggctcagaacgaacgctggcggcaggcttaacacatgcaagtcgagcgccccgcaaggggagcggcagacgggtgagtaacgcgtgggaacatacccaaccctacggaataacccagggaaacttggactaataccgtatacgcccttttggggaaagatttatcggggatggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgccacgaccggtagagagatttacctttcccttcggggacgtggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggggtgaccctgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcactgcgctaaccgcaagggggcaggtgaccacggtagggtcagcgactggggtgaagtcgtaacaaggtagccgtaggggaacctgcggctggatcacctccttt

SEQ ID NO: 5995 - DNA, 1482 bp, Neorhizobium sp. T25 13
  ref <308>: DATABASE ACCESSION NUMBER: NCBI ACCESSION: NZ_PVBI01000035.1
  ref <309>: DATABASE ENTRY DATE: 2019-04-01
  ref <313>: RELEVANT RESIDUES IN SEQ ID NO: (1)..(1482)
tcaacttgagagtttgatcctggctcagaacgaacgctggcggcaggcttaacacatgcaagtcgagcgcctcgcaagaggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 5996 - DNA, 1482 bp, Neorhizobium sp. T25 27
  ref <308>: DATABASE ACCESSION NUMBER: NCBI ACCESSION: NZ_PVBJ01000031.1
  ref <309>: DATABASE ENTRY DATE: 2019-04-01
  ref <313>: RELEVANT RESIDUES IN SEQ ID NO: (1)..(1482)
tcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 5997 - DNA, 1482 bp, Neorhizobium sp. T6 25
  ref <308>: DATABASE ACCESSION NUMBER: NCBI ACCESSION: NZ_PVBL01000053.1
  ref <309>: DATABASE ENTRY DATE: 2019-04-01
  ref <313>: RELEVANT RESIDUES IN SEQ ID NO: (1)..(1482)
tcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgccctttgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 5998 - DNA, 1482 bp, Neorhizobium sp. T7 12; identical to SEQ ID NO: 5996
  ref <308>: DATABASE ACCESSION NUMBER: NCBI ACCESSION: NZ_PVBK01000040.1
  ref <309>: DATABASE ENTRY DATE: 2019-04-01
  ref <313>: RELEVANT RESIDUES IN SEQ ID NO: (1)..(1482)

SEQ ID NO: 5999 - DNA, 1482 bp, Neorhizobium tomejilense; identical to SEQ ID NO: 5996
  ref <308>: DATABASE ACCESSION NUMBER: NCBI ACCESSION: NZ_PVBG01000052.1
  ref <309>: DATABASE ENTRY DATE: 2019-04-01
  ref <313>: RELEVANT RESIDUES IN SEQ ID NO: (1)..(1482)

SEQ ID NO: 6000 - DNA, 1499 bp, Neorickettsia helminthoeca
  ref <308>: DATABASE ACCESSION NUMBER: NCBI ACCESSION: NZ_CP007481.1
  ref <309>: DATABASE ENTRY DATE: 2019-04-01
  ref <313>: RELEVANT RESIDUES IN SEQ ID NO: (1)..(1499)
ttttttgagagtttgatcctggctcagaacgaacgctagcggtaggcttaacacatgcaagtcgaacggacttttgactgcttgcagtcgaaagtcagtggcagacgggtgcgtaacgcgtgggaacttacctggtagtagggaataaccaatggaaacattgggtaatactctatacgccctcagggggaaagatttattgctatcagataggcccgcgttagattagcttgttggtgaggtaatggctcaccaaggcgacgatctatagctggtctgagaggatgatcagccacactggaactgagacacggtccagactcctacgggaggcagcagtgaggaatattggacaatgggcgaaagcctgatccagccatgccgcatgagtgatgaaggcccttgggttgtaaagctcttttagtggggaagataatgacggtacccacagaagaagtcccggctaactccgtgccagcagccgcggtaatacggagggggctagcgttgttcggaattactgggcgtaaagggtgcgtaggcggtctcgcaagttaggtgtgaaatcctcgggctcaacctgagaactgcatttaaaactgcgagactcgaacgtgagagagggcaatggaatttttggtgtaggggtgaaatccgtagatatcaagaggaacgtcaggggcgaaagcgattgcctggatcatagttgacgctgaggcacgaaagcgtggggagcaaacaggattagataccctggtagtccacgctgtaaacgatgagtgttaaaagtgggttattttatctgctttgtagctaacgcggtaaacactccgcctggggactacggtcgcaagactaaaactcaaaggaattgacggggactcgcacaagcggtggagtatgtggtttaattcgatgcaacgcgaaaaaccttaccacaccttgacatgtagatcgtatctccctgaagggggagagtcagttcggctggatctaacacaggtgttgcatggctgtcgtcagctcgtgtcgtgagatgttgggttaagtcccgcaacgagcgcaaccctcatccttagttgccagcggttcggccgggaactttagggaaactgccagtgacaaactggaggaaggcggggacgacgtcaagtcatcatggcccttatggtgtgggctacacacgtactacaatggcaattacaatgagctagctatactgcaaggtaacgcaaatctttgaaaagttgtctcagtacggattgccttctgcaactcgaaggcatgaagttggaatcgctagtaatcgcagatcagcatgctgcggtgaatacgttctcgggtcttgtacacactgcccgtcaagccatggaagtttattttactcgaagctagtgagctaaccgcaaggaggcagctatctacagtgggataagtgactggggttaagtcgtaacaaggtagccgtaggtgaacctgcggctggattacctcctttt

SEQ ID NO: 6001 - DNA, 1501 bp, Neorickettsia risticii
  ref <308>: DATABASE ACCESSION NUMBER: NCBI ACCESSION: NC_013009.1
  ref <309>: DATABASE ENTRY DATE: 2019-04-01
  ref <313>: RELEVANT RESIDUES IN SEQ ID NO: (1)..(1501)
tcctgatttgagagtttgatcctggctcagaacgaacgctagcggtaggcttaacacatgcaagtcgaacggaatcagggctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagataatgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaagaactgcatttaaaactgtgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggattgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgagctagctacaccgtaaggtgacgccaatctcttaaaggttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctcctttt

SEQ ID NO: 6002 - DNA, 1499 bp, Neorickettsia sennetsu
  ref <308>: DATABASE ACCESSION NUMBER: NCBI ACCESSION: NC_007798.1
  ref <309>: DATABASE ENTRY DATE: 2019-04-01
  ref <313>: RELEVANT RESIDUES IN SEQ ID NO: (1)..(1499)
ctgatttgagagtttgatcctggctcagaacgaacgctagcggtaggcttaacacatgcaagtcgaacggaatcaaagctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagatagtgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaggaactgcatttaaaactgcgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggatcgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgggctagctacaccgtaaggtgatgcaaatctcctaaaagttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctcctttt

SEQ ID NO: 6003 - DNA, 1499 bp, Neorickettsia sp. 179522
  ref <308>: DATABASE ACCESSION NUMBER: NCBI ACCESSION: NZ_LNGI01000001.1
  ref <309>: DATABASE ENTRY DATE: 2019-04-01
  ref <313>: RELEVANT RESIDUES IN SEQ ID NO: (1)..(1499)
ctgatttgagagtttgatcctggctcagaacgaacgctagcggtaggcttaacacatgcaagtcgaacggaatcaaagctgcttgcagcttcggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagataatgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaagaactgcatttaaaactgtgggactcgaacgtgatagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggatcgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgagctagctacaccgtaaggtgatgccaatctcttaaaagttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctcctttt

SEQ ID NO: 6004 - DNA, 1495 bp, Neosynechococcus sphagnicola
  ref <308>: DATABASE ACCESSION NUMBER: NCBI ACCESSION: NZ_JJML01000087.1
  ref <309>: DATABASE ENTRY DATE: 2019-04-01
  ref <313>: RELEVANT RESIDUES IN SEQ ID NO: (1)..(1495)
aacatggagagtttgatcctggctcaggatgaacgctggcggtctgcttaacacatgcaagtcgaacgggctcttcggagctagtggcggacgggtgagtaacgcgtgagaatctgcctacaggtctgggacaacagttggaaacggctgctaataccggatgtgccgagaggtgaaagctttagtgcctgtagatgagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaagaccgcgtgagggaggaaggcttttgggttgtaaacctcttttctcagggaagaagatctgacggtacctgaggaatcagcatcggctaactccgtgccagcagccgcggtaatacggaggatgcaagcgttatccggaattattgggcgtaaagcgtccgcaggtggttttacaagtctgctgttaaagcgcggagcttaacttcgtaacggcggtggaaactgtgagactagagtacggtaggggtagcgggaattcccggtgtagcggtgaaatgcgtagatatcgggaagaacaccagcggcgaaagcgcgctactgggcctgtactgacactgagggacgaaagctaggggagcgaaagggattagatacccctgtagtcctagctgtaaacgatggatactaggtgttgcgcgtatcgacccgagcagtgccgtagctaacgcgttaagtatcccgcctggggagtacgctcgcaagagtgaaactcaaaggaattgacgggggcccgcacaagcggtggagtatgtggtttaattcgatgcaacgcgaagaaccttaccagggcttgacatgtcgcgaattccggtgaaagtcgggagtgccttcgggagcgcgaacacaggtggtgcatggctgtcgtcagctcgtgtcgtgagatgttgggttaagtcccgcaacgagcgcaacccacgtctttagttgccagcattaagttgggcactttagagagactgccggtgacaaaccggaggaaggtgtggatgacgtcaagtcagcatgccccttacgtcctgggctacacacgtactacaatgcttcggacagagggttgcgagctagcgatagcaagctaatcccgtaaaccgaggctcagttcagattgcaggctgcaactcgcctgcatgaaggcggaatcgctagtaatcgcaggtcagcatactgcggtgaatacgttcccgggccttgtacacaccgcccgtcacaccatgggagttggccacgcccgaagtcgttactccaaccgcttgcggaggaggatgcctaaggcagggctgatgactggggtgaagtcgtaacaaggtagccgtaccggaaggtgtggctggatcacctcctttataggga

SEQ ID NO: 6005 - DNA, 1475 bp, Neptunicoccus sediminis
  ref <308>: DATABASE ACCESSION NUMBER: NCBI ACCESSION: NZ_MDVX01000073.1
  ref <309>: DATABASE ENTRY DATE: 2019-04-01
  ref <313>: RELEVANT RESIDUES IN SEQ ID NO: (1)..(1475)
caacttgagagtttgatcctggctcagaacgaacgctggcggcaggcctaacacatgcaagtcgagcgcttcccttcggggaggagcggcggacgggttagtaacgcgtgggaatatacccagttctaaggaatagtctcgggaaactgagggtaataccttatacgcccttcgggggaaagatttatcggaattggattagcccgcgttagattagatagttggtggggtaacggcctaccaagtcgacgatctatagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggaccagcaagttaggggtgaaatcccggggctcaaccccggaactgcccttaaaactgttgatcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgcggttacgagagatcgtttccttcagttcggctggatatcatacaggtgctgcatggctgtcgtcagctcgtgtcgtgagatgttcggttaagtccggcaacgagcgcaacccacgtccttagttaccagcatttagttgggtaccctaaggagaccgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggatctacccgaaggtggtgcgccaacctagcaatagggggcagccaaccacggtaggttcagtgactggggtgaagtcgtaacaaggtagccctaggggaacctggggctggatcacctcctttctaa

SEQ ID NO: 6006 - DNA, 1543 bp, Neptunomonas sp. HPM-16
  ref <308>: DATABASE ACCESSION NUMBER: NCBI ACCESSION: NZ_SACQ01000018.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagatctagcttgctagatgctgacgagcggcggacgggtgagtaacgcgtaggaaactgccgagtagtgggggatagcccagagaaatttggattaataccgcatacgccctacgggggaaaggaggggatcttcggacctttcgctattcgatgtgcctgcgtgagattagcttgttggtgaggtaaaggctcaccaaggcgacgatctctagctggtttgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagcagtgaggaaaggttataagttaataccttatagctgtgacgttaactgcagaagaaggaccggctaactccgtgccagcagccgcggtaatacggagggtccgagcgttaatcggaattactgggcgtaaagcgcgcgtaggcggctaggtcagtcagatgtgaaagccccgggcttaacctgggaattgcatctgatactgcttggctagagtacagaagagggtggtggaatttcctgtgtagcggtgaaatgcgtagatataggaaggaacatcagtggcgaaggcggccacctggactgatactgacgctgaggtgcgaaagcgtggggagcaaacaggattagataccctggtagtccacgccgtaaacgatgtcaactagccgttggggtacttgatactttagtggcgcagctaacgcgataagttgaccgcctggggagtacggtcgcaagattaaaactcaaatgaattgacgggggcccgcacaagcggtggagcatgtggtttaattcgaagcaacgcgaagaaccttacctactcttgacatcctgcgaacttgctagagatagcttggtgccttcgggaacgcagtgacaggtgctgcatggctgtcgtcagctcgtgttgtgaaatgttgggttaagtcccgtaacgagcgcaacccttgtccttatttgccagcacttcgggtgggaactctaaggagactgccggtgacaaaccggaggaaggtggggacgacgtcaagtcatcatggcccttacgagtagggctacacacgtgctacaatggctggtacagagggccgcgaacctgcgagggtgagctaatctcagaaaaccagtcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtagctagcttaaccttcgggagggcggttaccacggtgtggttcatgactggggtgaagtcgtaacaaggtagccctaggggaacctggggctggatcacctccttaaac

SEQ ID NO: 6007 - DNA, 1467 bp, Nereida ignava
  ref <308>: DATABASE ACCESSION NUMBER: NCBI ACCESSION: NZ_FORZ01000025.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcacgcctaacacatgcaagtcgagcgctcacttcggtgggagcggcggacgggttagtaacgcgtgggaacataccctttactacggaatagcctttggaaacgaagagtaataccgtatacgccctacgggggaaagatttatcggtaaaggattggcccgcgttagattagatagttggtggggtaacggcctaccaagtctacgatctatagctggtttgagaggatgatcagcaacactgggactgagacacggcccagactcctacgggaggcagcagtggggaatcttagacaatgggggaaaccctgatctagcgatgccgcgtgtgtgacgaaggccttagggtcgtaaagcactttcgccagagatgataatgacagtatctggtaaagaaaccccggctaactccgtgccagcagccgcggtaatacggagggggttagcgttgttcggaattactgggcgtaaagcgtacgtaggcggattagtaagttagaggtgaaatcccagggctcaaccctggaactgcctttaatactgctagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggtagtatactattcggtgacacacctaacggagtaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacacggagagatccgtggttcccttcggggacgcagtgacaggtgctgcatggctgtcgtcagctcgtgtcgtgagatgttcggttaagtccggcaacgagcgcaacccacacccctagttgccagcagttcggctgggcactctatgggaactgcccgtgataagcgggaggaaggtgtggatgacgtcaagtcttcatggcccttacgggttgggctacacacgtgctacaatggcaagtacagtgggttaatccccaaaacttgtctcagttcggattggggtctgcaactcgaccccatgaagtcggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 6008 - DNA, 1486 bp, Nesiotobacter exalbescens
  ref <308>: DATABASE ACCESSION NUMBER: NCBI ACCESSION: NZ_NKQT01000013.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcctaacacatgcaagtcgagcggtcccttcggggatagcggcagacgggtgagtaacgcgtgggaacctatccatcggtacggaatagctccgggaaactggaattaataccgtatgcgccctacgggggaaagatttatcgccgatggccgggcccgcgttggattagctagtaggttgggtaatggctgacctaggcgacgatccatagctggtctgagaggatgatcagccacactgggactgagacacggcccagactcctacgggaggcagcagtggggaatattggacaatgggggcaaccctgatccagccatgccgcgtgagtgatgacggccttagggttgtaaagctctttcagcagtgaagataatgacattatctgcagaagaagccccggctaacttcgtgccagcagccgcggtaatacgaagggggctagcgttgttcggaatcactgggcgtaaagcgcgcgtaggcggattgataagttaggggtgaaatcccgaggctcaacctcggaactgcctttgatactgtcagtcttgagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatggaagctagttgtcaggcagcatgctgtttggtgacgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggcgctacacagagagatttgtggttcccttcggggacgtcaggacaggtgctgcatggctgtcgtcagctcgtgtcgtgagatgttgggttaagtcccgcaacgagcgcaaccctcgcccttagttgccatcattcagttgggcactctagggggactgccggtgataagccggaggaaggtggggatgacgtcaagtcctcatggcccttacgggctgggctacacacgtgctacaatggcggtgacagtgggcagcgacctcgcgagggggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccctaggggaacctggggctggatcacctcctttctaag

SEQ ID NO: 6009 - DNA, 1537 bp, Nesterenkonia sp. M8
  ref <308>: DATABASE ACCESSION NUMBER: NCBI ACCESSION: NZ_QYZP01000004.1
  ref <309>: DATABASE ENTRY DATE: 2019-04-01
  ref <313>: RELEVANT RESIDUES IN SEQ ID NO: (1)..(1537)
tttgatggagagtttgatcctggctcaggatgaacgctggcggcgtgcttaacacatgcaagtcgaacgatgaagctggtgcttgcactggtggattagtggcgaacgggtgagtatcacgtgagtaaccttcccttgactctgggataagcccgggaaactgggtctaataccggatatgaccggcctccgcatggggtgctggtggaaagcttttgcggttttggatggactcgcggcctatcagtttgttggtgaggtaatggctcaccaaggcgatgacgggtagccggcctgagagggtgaccggccacactgggactgagacacggcccagactcctacgggaggcagcagtggggaatattgcacaatgggcgcaagcctgatgcagcgacgccgcgtgcgggatgacggccttcgggttgtaaaccgctttcagcaaggaagaagctttttgtgacggtacttgcagaagaagcgccggctaactacgtgccagcagccgcggtaatacgtagggcgcgagcgttatccggaattattgggcgtaaagagctcgtaggcggtttgccacgtctgctgtgaaagcccggggctcaacctcgggtgtgcagtgggtacgggtaggctggagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggatcgctgcagagatgcagtttcccttcggggctggttcacaggtggtgcatggttgtcgtcagctcgtgtcgtgagatgttgggttaagtcccgcaacgagcgcaacccttgtcttatgttgccagcacgtagtggtggggactcatgggagactgccggggtcaactcggaggaaggtggggacgacgtcaaatcatcatgccccttatgtcttgggcttcacgcatgctacaatggccggtacaatgggttgcgatactgtgaggtggagctaatccctaaaagccggtctcagttcggatcgaagtctgcaactcgacttcgtgaagttggagtcgctagtaatcgcagatcagcaatgctgcggtgaatacgttcccgggccttgtacacaccgcccgtcaagtcacgaaagttggtaacacccgaagctcatggcctaaccagttttctggagggaatggtcgaaggtgggactggcgattgggactaagtcgtaacaaggtagccgtaccggaaggtgcggctggatcacctcctttctaagga

SEQ ID NO: 6010 - DNA, 1541 bp, Nesterenkonia sp. RB2
  ref <308>: DATABASE ACCESSION NUMBER: NCBI ACCESSION: NZ_QWLD01000028.1
  ref <309>: DATABASE ENTRY DATE: 2019-04-01
  ref <313>: RELEVANT RESIDUES IN SEQ ID NO: (1)..(1541)
tttgatggagagtttgatcctggctcaggatgaacgctggcggcgtgcttaacacatgcaagtcgaacgatgaagctctcagcttgctgggggtggattagtggcgaacgggtgagtatcacgtgagtaaccttcccttgactctgggataagcctgggaaactgggtctaataccggatatgactggtcatcgcatggtggctggtggaaagctttttgcggttttggatgggctcgcggcctatcagcttgacggtggggtagtggcctaccgtggctttgacgggtagccggcctgagagggtgaccggccacactgggactgagacacggcccagactcctacgggaggcagcagtggggaatattgcacaatgggcgcaagcctgatgcagcgacgccgcgtgcgggatgacggctttcgggttgtaaaccgctttcagcacagaagaagcgtaattgtgacggtatgtgcagaagaagcgccggctaactacgtgccagcagccgcggtaatacgtagggcgcgagcgttatccggaattattgggcgtaaagagctcgtaggcggtttgccacgtctgctgtgaaagcccggggcttaactccgggtgtgcagtgggtacgggtaggctggagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggatcgcagcagagatgttgtttcccttcggggctggttcacaggtggtgcatggttgtcgtcagctcgtgtcgtgagatgttgggttaagtcccgcaacgagcgcaacccttgtcttatgttgccagcacgtaatggtggggactcatgggagactgccggggtcaactcggaggaaggtggggatgacgtcaaatcatcatgccccttatgtcttgggcttcacgcatgctacaatggccggtacagtgggttgcgatgccgtgaggtggagctaatccctaaaagccggtctcagttcggatcgaagtctgcaactcgacttcgtgaagttggagtcgctagtaatcgcagatcagcaatgctgcggtgaatacgttcccgggccttgtacacaccgcccgtcaagtcacgaaagttggtaacacccgaagcccatggcccaaccggttttgctggggggaatggtcgaaggtgggactggcgattgggactaagtcgtaacaaggtagccgtaccggaaggtgcggctggatcacctcctttctaagga

SEQ ID NO: 6011 - DNA, 1535 bp, Niastella koreensis
  ref <308>: DATABASE ACCESSION NUMBER: NCBI ACCESSION: NZ_LWBO01000054.1
  ref <309>: DATABASE ENTRY DATE: 2019-04-01
  ref <313>: RELEVANT RESIDUES IN SEQ ID NO: (1)..(1535)
acaatggagagtttgatcctggctcaggatgaacgctagcggcaggcttaatacatgcaagtcgaggggcagcgcagtgtagcaatacatgggcggcgaccggcaaacgggtgcggaacacgtacgcaaccttccttcaagcgggggatagctttcggaaacgaaaattaataccccatagtaatgtctgatggcatctgaggacatttaaagatttatcacttgaagatgggcgtgcgcctgattaggtagttggcggggtaacggcccaccaagcctacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatcggagaagaaacccacgaattcttttgtggttgacggtacccgatgaataagcaccggctaactccgtgccagcagccgcggtaatacggagggtgcaagcgttatccggattcactgggtttaaagggagcgtaggtgggctggtaagtcagtggtgaaatctccgggcttaactcggaaactgccgttgatactatcagtcttgaatgttgtggaggtaagcggaatatgtcatgtagcggtgaaatgcttagatatgacatagaacaccgatagcgaaggcagcttgctacacaattattgacactgaggctcgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcaatttgaccgtgggtgaaagctcattttgtagcaatacacagattgtaaggtgctgcatggctgtcgtcagctcgtgccgtgaggtgttgggttaagtcccgcaacgagcgcaacccccatcattagttgccatcaggtaaagctgggaactctaatgaaactgccgtcgtaagacgcgaggaaggaggggatgatgtcaagtcatcatggcctttatgcccagggctacacacgtgctacaatggaagggacaaagagctgccacttggcaacaaggcgctaatctcaaaaaccctttctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagccgcctagggtaaaactagtgactggggctaagtcgtaacaaggtagccgtatcggaaggtgcggctggaatacctcctttttagag

SEQ ID NO: 6012 - DNA, 1539 bp, Niastella populi
  ref <308>: DATABASE ACCESSION NUMBER: NCBI ACCESSION: NZ_LWBP01000037.1
  ref <309>: DATABASE ENTRY DATE: 2019-04-01
  ref <313>: RELEVANT RESIDUES IN SEQ ID NO: (1)..(1539)
ttacaatggagagtttgatcctggctcaggatgaacgctagcggcaggcttaatacatgcaagtcgaggggcagcatgactgtagcaatacagttgatggcgaccggcaaacgggtgcggaacacgtacgcaaccttccttcaaatgggggatagcccaccgaaaggtggattaataccccgtaaaatttttgggtggcatcacctgattattatagctccggcgtttgaagatgggcgtgcgcctgattaggtagttggcggagtaacagcccaccaagcctacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatcggagaagaaacccatactttctagtgtggttgacggtacccgatgaataagcaccggctaactccgtgccagcagccgcggtaatacggagggtgcaagcgttatccggattcactgggtttaaagggtgcgtaggtgggttggtaagtcagtggtgaaatctccgggcttaactcggaaactgccgttgatactatcaatcttgaatgttgtggaggtaagcggaatatgtcatgtagcggtgaaatgcttagatatgacatagaacaccgatagcgaaggcagcttgctacacaataattgacactgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagattgaccgtgggtgaaagctcattttgtagcaatacacagtctgtaaggtgctgcatggctgtcgtcagctcgtgccgtgaggtgttgggttaagtcccgcaacgagcgcaacccccatcattagttgccatcaggtaaagctgggaactctaatgaaactgccgtcgtaagacgcgaggaaggaggggatgatgtcaagtcatcatggcctttatgcccagggctacacacgtgctacaatgggagggacaaagagctgccacttggcgacaaggagctaatctcaaaaaccctttctcagttcagatcgcagtctgcaactcgactgcgtgaagctggaatcgctagtaatcgtatatcagcaatgatacggtgaatacgttcccggaccttgcacacaccgcccgtcaagccatggaagctgggtgtacctaaagtcggtaaccgcaaggagccgcctagggtaaaactagtgactggggctaagtcgtaacaaggtagccgtatcggaaggtgcggctggaatacctcctttttagag

SEQ ID NO: 6013 - DNA, 1353 bp, Niastella yeongjuensis
  ref <308>: DATABASE ACCESSION NUMBER: NCBI ACCESSION: NZ_FOCZ01000036.1
  ref <309>: DATABASE ENTRY DATE: 2019-04-01
  ref <313>: RELEVANT RESIDUES IN SEQ ID NO: (1)..(1353)
aatgtctgagggcatctgaggacatttaaagatttatcacttgaagatgggcgtgcgcctgattaggtagttggcggggtaacggcccaccaagcctacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatcggagaagaaaccccagatttttatttgggttgacggtacccgatgaataagcaccggctaactccgtgccagcagccgcggtaatacggagggtgcaagcgttatccggattcactgggtttaaagggagcgtaggtgggctggtaagtcagtggtgaaatctccgggcttaactcggaaactgccgttgatactatcagtcttgaatattgtggaggtaagcggaatatgtcatgtagcggtgaaatgcttagatatgacatagaacaccgatagcgaaggcagcttgctacacaattattgacactgaggctcgaaagcgtggggatcaaacaggattagataccctggtagtccacgccctaaacgatggatactcgacatatgcgatacacagtatgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagattgaccgtgggtgaaagctcattttgtagcaatacacagtctgtaaggtgctgcatggctgtcgtcagctcgtgccgtgaggtgttgggttaagtcccgcaacgagcgcaacccccatcattagttgccatcaggtaaagctgggaactctaatgaaactgccgtcgtaagacgcgaggaaggaggggatgatgtcaagtcatcatggcctttatgcccagggctacacacgtgctacaatggaagggacaaagagctgccacttggcaacaaggcgctaatctcaaaaaccctttctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagccgcctagggtaaaactagtgactggggctaagtcgtaacaaggtagccgtatcggaaggtgcggctggaatacctcctttttagag

SEQ ID NO: 6014 - DNA, 1473 bp, Nioella nitratireducens
  ref <308>: DATABASE ACCESSION NUMBER: NCBI ACCESSION: NZ_MNBW01000043.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtgggaacgtacccttttctaaggaatagccactggaaacggtgagtaataccttatacgcccttcgggggaaagatttatcggggaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgatcgcggttaccggagacggtttccttcagctcggctggatcggtgacaggtgctgcatggctgtcgtcagctcgtgtcgtgagatgttcggttaagtccggcaacgagcgcaacccacatccttagttgccagcaggtcaagctgggcactctagggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccctaggggaacctggggctggatcacctcctttctaa

SEQ ID NO: 6015 - DNA, 1472 bp, Nioella sp. Z7-4
  ref <308>: DATABASE ACCESSION NUMBER: NCBI ACCESSION: NZ_RCIQ01000062.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgctctcttcggagggagcggcggacgggtgagtaacgcgtgggaacgtacccttttctacggaatagcctcgggaaactgagagtaataccgtatacgcccttcgggggaaagatttatcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctgtcgcggttaccggagacggtttccttcagttcggctggacaggtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggtaatgacaatgggttaatcccaaaaagttatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccctaggggaacctggggctggatcacctcctttctaa

SEQ ID NO: 6016 - DNA, 1430 bp, Nisaea denitrificans
  ref <308>: DATABASE ACCESSION NUMBER: NCBI ACCESSION: NZ_AUFM01000008.1
  ref <309>: DATABASE ENTRY DATE: 2019-04-01
  ref <313>: RELEVANT RESIDUES IN SEQ ID NO: (1)..(1430)
ccttcgggtactggacagtggcgcacgggtgagtaacgcgtgggaacctgccctgaggtacgggataacggctggaaacggccgctaataccgtatgtcccctgcgggggaaagatttatcgccttgggaggggcccgcgtccgattagctagttggtgaggtaatggctcaccaaggcgacgatcggtagctggtctgagaggatgatcagccacactgggactgagacacggcccagactcctacgggaggcagcagtggggaatattggacaatgggggcaaccctgatccagcaatgccgcgtgtgtgatgaaggccttagggttgtaaagcactttcactggtgaagatgatgacggtagccagagaagaagccccggctaactccgtgccagcagccgcggtaatacggagggggcaagcgttgttcggaattactgggcgtaaagggcgtgtaggcggcggttttagtcaggcgtgaaagcccggggctcaacctcggaatagcgcttgatactgaactgcttgagaccggaagagggtagtggaattcccagtgtagaggtgaaattcgtagatattgggaagaacaccagtggcgaaggcggctacctggtccggatctgacgctgaggcgcgaaagcgtggggagcaaacaggattagataccctggtagtccacgccgtaaacgatgaatgctagacgttggggaacttgttcttcagtgtcgccgctaacgcattaagcattccgcctggggagtacggtcgcaagattaaaactcaaaggaattgacgggggcccgcacaagcggtggagcatgtggtttaattcgaagcaacgcgcagaaccttaccagcccttgacatggggattttggtcaccggagacggtgtccttcagttcggctggatcccgcacaggtgctgcatggctgtcgtcagctcgtgtcgtgagatgttgggttaagtcccgcaacgagcgcaaccctcatcttcagttgccatcaggtttggctgggcactctggagaaactgcccgtgacaagcgggaggaaggcggggatgacgtcaagtcctcatggcccttacgggctgggctacacacgtgctacaatggcggtgacaatgggcagcgaaggggcgacctggagctaatccccaaaaaccgtctcagttcggattgtactctgcaactcgagtgcatgaaggtggaatcgctagtaatcgtggatcagcatgccacggtgaatacgttcccgggccttgtacacaccgcccgtcacaccatgggagttggttttacccgaaggtggtgagctaacccgcaagggaagcagccaaccacggtaaggtcagcgactggggtgaagtcgtaacaaggtagccgtaggggaacctgcggctggatcacctcctttctaagg

SEQ ID NO: 6017 - DNA, 1491 bp, Nitratireductor basaltis
  ref <308>: DATABASE ACCESSION NUMBER: NCBI ACCESSION: NZ_CP019044.1
  ref <309>: DATABASE ENTRY DATE: 2019-04-01
  ref <313>: RELEVANT RESIDUES IN SEQ ID NO: (1)..(1491)
aacctgagagtttgatcctggctcagaacgaacgctggcggcaggcctaacacatgcaagtcgaacgccccttcgggggagtggcagacgggtgagtaacacgtgggaatctacccagtactacggaataactcagggaaacttgagctaataccgtatacgccctacgggggaaagatttatcggtattggatgagcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccctagggttgtaaagctctttcaacggtgaagataatgacggtaaccgtagaagaagccccggctaacttcgtgccagcagccgcggtaatacgaagggggctagcgttgttcggaataactgggcgtaaagcgcacgtaggcggactattaagtcaggggtgaaatcccggggctcaaccccggaactgcctttgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagctgtcaggctgtttacagtttggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggtttccagagatggtttccttcagttcggctggatcggtgacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacaatgggcagccaggccgcaaggtcgagctaatctccaaaagccatctcagttcggattgttctctgcaactcgagagcatgaagttggaatcgctagtaatcgtggatcagcatgccacggtgaatacgttcccgggccttgtacacaccgcccgtcacaccatgggagttgggtttacccgaaggcagtgcgccaaccttttggaggcagctgaccacggtaggctcagcgactggggtgaagtcgtaacaaggtagccgtaggggaacctgcggctggatcacctcctttctaagga

SEQ ID NO: 6018 - DNA, 1490 bp, Nitratireductor indicus
  ref <308>: DATABASE ACCESSION NUMBER: NCBI ACCESSION: NZ_FOXZ01000006.1
  ref <309>: DATABASE ENTRY DATE: 2019-04-01
  ref <313>: RELEVANT RESIDUES IN SEQ ID NO: (1)..(1490)
aacatgagagtttgatcctggctcagaacgaacgctggcggcaggcttaacacatgcaagtcgagcgccccgcaaggggagcggcagacgggtgagtaacgcgtgggaatctacctagctctacggaataactcagggaaacttgaactaataccgtatacgccctttgggggaaagatttatcggagttggatgagcccgcgtctgattagctagttggtggggtaaaggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggaccattaagtcaggggtgaaatcccggggctcaaccccggaactgcctttgatactggtggtctcgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgttggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatctgggtcgcggaaaccggagacggtttccttcagttaggctggacccaagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccgtaggggaacctgcggctggatcacctcctttctaagg

SEQ ID NO: 6019 - DNA, 1490 bp, Nitratireductor pacificus
  ref <308>: DATABASE ACCESSION NUMBER: NCBI ACCESSION: NZ_AMRM01000023.1
  ref <309>: DATABASE ENTRY DATE: 2019-04-01
  ref <313>: RELEVANT RESIDUES IN SEQ ID NO: (1)..(1490)
aacatgagagtttgatcctggctcagaacgaacgctggcggcaggcttaacacatgcaagtcgagcgccccgcaaggggagcggcagacgggtgagtaacacgtgggaatctacccagctctacggaataactcagggaaacttgaactaataccgtatacgtcctccgggagaaagatttatcggagttggatgagcccgcgtctgattagctagttggtggggtaaaggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcggtcagttaggggtgaaatcccggggctcaaccccggaactgcctctaatactgccggtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggtttccagagatggattccttcagttaggctggatcggtgacaggtgctgcatggctgtcgtcagctcgtgtcgtgagatgttgggttaagtcccgcaacgagcgcaaccctcgcccttagttgccagccttaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccgtaggggaacctgcggctggatcacctcctttctaagg

SEQ ID NO: 6020 - DNA, 1490 bp, Nitratireductor sp. StC3
  ref <308>: DATABASE ACCESSION NUMBER: NCBI ACCESSION: NZ_PYBP01000017.1
  ref <309>: DATABASE ENTRY DATE: 2019-04-01
  ref <313>: RELEVANT RESIDUES IN SEQ ID NO: (1)..(1490)
tcaacatgagagtttgatcctggctcagaacgaacgctggcggcaggcttaacacatgcaagtcgagcgcactcttcggagtgagcggcagacgggtgagtaacgcgtgggaatctacccagctctacggaataactcagggaaacttgtgctaataccgtatacgtcctccgggagaaagatttatcggagttggatgagcccgcgttgcattagctagttggtggggtaatggcccaccaaggcgacgatgcatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcggtcagttaggggtgaaatcccggggctcaaccccggaactgcctctaatactgccgatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcggcaggtttacctgtcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgtggtttccagagatggattccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctccttt

SEQ ID NO: 6021 - DNA, 1548 bp, Nitratiruptor sp. SB155-2
  ref <308>: DATABASE ACCESSION NUMBER: NCBI ACCESSION: NC_009662.1
  ref <309>: DATABASE ENTRY DATE: 2019-04-01
  ref <313>: RELEVANT RESIDUES IN SEQ ID NO: (1)..(1548)
tttttatggagagtttgatcctggctcagagtgaacgctggcggcgtgcctaacacatgcaagtcgagcgagaacggctcaatgatcccttcggggagatttgagtgtcagctaagcggcgcacgggtgagtaacacgtagctaacctgccccatagcgggggataacagcccgaaagggctgctaataccctatactccttcttggcacaagtcaggttgtggaaagcgttatgtagcgctatgggatggggctgcggcctatcagctagttggtggggtaacggcctaccaaggcaatgacgggtagctggtctgagaggatgatcagccacactggaactgagacacggtccagactcctacgggaggcagcagtggggaatattgcgcaatgggggcaaccctgacgcagcaacgccgcgtggaggatgacgcccttcggggtgtaaactccttttgcaggggaagataatgacggtaccctgcgaataagcaccggctaactccgtgccagcagccgcggtaatacggagggtgcaagcgttactcggaatcactgggcgtaaagggcgcgtaggcggcttggtaagttggatgtgaaagcccacggctcaaccgtggaactgcgtccaaaactgccaggctagagtccgggagaggcagatggaattggtggtgtaggggtaaaatccgtagagatcaccaggaatacccattgcgaaggcgatctgctggaacggtactgacgctgaggcgcgaaagcgtggggagcaaacaggattagataccctggtagtccacgccctaaacgatggatgctagtcgttgtggtgctagtcactgcagtgatgcagctaacgcattaagcatcccgcctggggagtacggccgcaaggctaaaactcaaaggaatagacggggacccgcacaagcggtggagcatgtggtttaattcgaagatacgcgaagaaccttacctgggcttgacatcccgagaaccctctagagatagaggggtgcctccttttggaggaactcggtgacaggtgctgcacggctgtcgtcagctcgtgtcgtgagatgttgggttaagtcccgcaacgagcgcaaccctcgtccttagttgccagcacttagggtgggcactctaaggagactgcccgggtaaccgggaggaaggtgaggatgacgtcaagtcatcatggcccttatgcccagggcgacacacgtgctacaatggcgcgtacagagagatgcgatactgcgaggtggagcaaatctctaaagcgcgtcccagttcggattgcagtctgcaactcgactgcatgaagtcggaatcgctagtaatcgcggatcagccatgccgcggtgaatacgttcccgggtcttgtactcaccgcccgtcacaccatgggagttgagctcacccgaagccgggggaccgacccgtaagggaggaccctcgtcgacggtgggctcagcgactggggtgaagtcgtaacaaggtaaccgtaggagaacctgcggttggatcacctcctttcta

SEQ ID NO: 6022 - DNA, 1535 bp, Nitratiruptor tergarcus
  ref <308>: DATABASE ACCESSION NUMBER: NCBI ACCESSION: NZ_FWWZ01000001.1
  ref <309>: DATABASE ENTRY DATE: 2019-04-01
  ref <313>: RELEVANT RESIDUES IN SEQ ID NO: (1)..(1535)
atttatggagagtttgatcctggctcagagtgaacgctggcggcgtgcttaacacatgcaagtcgagcgagaacggctctatccttcgggatagagtgtcagctaagcggcgcacgggtgagtaacacgtagctaacctgccccatagtgggggataacagcccgaaagggctgctaataccctatactccttccatacgaaagtatggttgtggaaagcgttagcgctatgggatggggctgcggcctatcagctagttggtggggtaaaggcctaccaaggctatgacgggtagctggtctgagaggatggtcagccacactggaactgagacacggtccagactcctacgggaggcagcagtggggaatattgcacaatgggggaaaccctgatgcagcaacgccgcgtggaggatgacgcccttcggggtgtaaactccttttgacagggaagaagatgacggtacctgtcgaataagcaccggctaactccgtgccagcagccgcggtaatacggagggtgcaagcgttactcggaatcactgggcgtaaagggcgcgtaggcggtctgctaagttggatgtgaaagcccacagcttaactgtggaactgcgtccaaaactggtagactagagtccggaagaggcaggtggaattggtggtgtaggggtaaaatccgtagagatcaccaggaatacccattgcgaaggcgacctgctgggacggtactgacgctgaggcgcgaaagcgtggggagcaaacaggattagataccctggtagtccacgccctaaacgatggatgctagtcgttggggtgctagtcacctcagtgatgcagctaacgcaataagcatcccgcctggggagtacggccgcaaggctaaaactcaaaggaatagacggggacccgcacaagcggtggagcatgtggtttaattcgaagatacgcgaagaaccttacctgggcttgacatccctggaaccctctagagatagaggggtgcctccttttgggggagccaggtgacaggtgctgcacggctgtcgtcagctcgtgtcgtgagatgttgggttaagtcccgcaacgagcgcaaccctcgtccttagttgccagcacttcgggtgggcactctaaggagactgcccgggtaaccgggaggaaggtgaggatgacgtcaagtcatcatggcccttatgcccagggcgacacacgtgctacaatggcgcgtacagagagaggcaataccgcgaggtggagcaaatctctaaagcgcgtcccagttcggattgcagtctgcaactcgactgcatgaagtcggaatcgctagtaatcgcggatcagccatgccgcggtgaatacgttcccgggtcttgtactcaccgcccgtcacaccatgggagttgagctcacccgaagccgggggaccgacccgaaagggaggacccctgtcgacggtgggctcagcgactggggtgaagtcgtaacaaggtaaccgtaggagaacctgcggttggatcacctcctttcta

SEQ ID NO: 6023 - DNA, 1497 bp, Nitrobacter hamburgensis
  ref <308>: DATABASE ACCESSION NUMBER: NCBI ACCESSION: NC_007964.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcgtagcaatacgtcagtggcagacgggtgagtaacacgtgggaacgtaccttttggttcggaacaactgagggaaacttcagctaataccggataagcccttacggggaaagatttatcgccgaaagatcggcccgcgtctgattagcttgttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcggatctttaagtcaggggtgaaatcctggagctcaactccagaactgcctttgatactgaaggtcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccatgaccggtcgcagagatgtgaccttctcttcggagcatggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcaaaggggcaacccctagcaaatctcaaaaaaccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaaggcggtgcgctaacccgcaagggaggcagccgaccacggtagggtcagcgactggggtgaagtcgtaacaaggtagccgtaggggaacctgcggctggatcacctcctttctaagg

SEQ ID NO: 6024 - DNA, 1493 bp, Nitrobacter sp. Nb-311A
  ref <308>: DATABASE ACCESSION NUMBER: NCBI ACCESSION: NZ_CH672416.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaacccagggaaacttgggctaataccggataagcccttacggggaaagatttatcgccgaaagatcggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaattactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccatgaccggtcgcagagatgtgaccttctcttcggagcatggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcaaaggggtgacccctagcaaatctcaaaaaaccgtctcagttcggattgggctctgcaacccgagcccatgaagttggaatcgctagtaatcgtggatcagcatgccacggtgaatacgttcccgggccttgtacacaccgcccgtcacaccatgggagttggttttacctgaaggcggtgcgctaacccgcaagggaggcagccgaccacggtagggtcagcgactggggtgaagtcgtaacaaggtagccgtaggggaacctgcggctggatcacctcctttct

SEQ ID NO: 6025 - DNA, 1497 bp, Nitrobacter winogradskyi
  ref <308>: DATABASE ACCESSION NUMBER: NCBI ACCESSION: NC_007406.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaacccagggaaacttgggctaataccggataagcccttacggggaaagatttatcgccgaaagatcggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaattactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccatgaccggtcgcagagatgtgaccttctcttcggagcatggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcaaaggggtgacccctagcaaatctcaaaaaaccgtctcagttcggattgggctctgcaacccgagcccatgaagttggaatcgctagtaatcgtggatcagcatgccacggtgaatacgttcccgggccttgtacacaccgcccgtcacaccatgggagttggttttacctgaaggcggtgcgctaacccgcaagggaggcagccgaccacggtagggtcagcgactggggtgaagtcgtaacaaggtagccgtaggggaacctgcggctggatcacctcctttctaagg

SEQ ID NO: 6026 - DNA, 1508 bp, Nitrolancea hollandica
  ref <308>: DATABASE ACCESSION NUMBER: NCBI ACCESSION: NZ_CAGS01000547.1
  ref <309>: DATABASE ENTRY DATE: 2019-04-01
  ref <313>: RELEVANT RESIDUES IN SEQ ID NO: (1)..(1508)
gatggagagtttgatcctggctcaggaacaacgctggcggcgtgcctaatgcatgcaagtcgcacgggaaccgcgcaagcggccgaccgtggcggacgggtgaggaacacgtggggaacctgcccacacgcgggggataacctcgggaaaccgagggtaaaaccccatgggcttggttggcgcaaggccgatcaagcaaaagcgcaagctgcgggtggagggccctgcggcctatcagctagacggtggggtagcggctcaccgtggcgatgacgggtcgctggtctgagaggacgatcagccacacggggactgagacacggccccgactcctacgggaggcagcagcaaggaattttccgcaatgggcgcaagcctgacggagcgacgccgcgtggaggaagacccccttcggggcgtaaactccttttgtgggggacgaagcaagtgacggtaccccacgaagaagcaccggctaactacgtgccagcagccgcggtaagacgtagggtgcaagcgttgtccggagttactgggcgtaaagggcgcgtaggcggttatccgcgtcgcacgtgaaagcccccggctcaaccggggagggtcgtgcgagacggggtaactggaggcagggagaggctggtggaattcccggtgtagtggtgaaatgcgtagagatcgggaggaacacctgaggcgaaggcggccagctggccctgtcctgacgctgaggcgcgaaggctcggggagcgaacgggattagataccccggtagtccgagcagtaaacgctgtggactaggtgtggggggagttgaccccctccgtgccggcgctaacgcagcaagtccaccgcctggggagtacggccgcaaggctaaaactcaaaggaattgacgggggcccgcacaagcagcggagcgtgtggtttaattcgacgcaacgcgcagaaccttaccagggcttgacagccaccgaacccgggtgaaagcctggggtgcccgcaagggaacggtgagacaggtgctgcatggctgtcgtcagctcgtgtcgtgagatgttgggttaagtcccgcaacgagcgcaacccctgtggctagttacgaggatgtctagccagacagccgggcgcaacccggaggaaggtggggatgacgtcaagtcagcatggcccatacgccctgggcgacacacacgctacaatggccgggacaacgggcagccaagcggtaacgcggagccaatcccccaaacccggtctcagttcagattgggggctgcaactcgcccccatgaaggcggagttgctagtaaccgccggtcagccatacggcggtgaatctgttcccgggccttgtacacaccgcccgtcacgtcatgaaagccggcaacacctgaagccggtgggccaacccgcaagggaggcagccgtcgagggtggggctggtgattgggacgaagtcgtaacaaggtagccgtagcggaagctgcggctggatcacctcctttcta

SEQ ID NO: 6027 - DNA, 1542 bp, Nitrosomonas sp. APG5
  ref <308>: DATABASE ACCESSION NUMBER: NCBI ACCESSION: NZ_PXXU01000028.1
  ref <309>: DATABASE ENTRY DATE: 2019-04-01
  ref <313>: RELEVANT RESIDUES IN SEQ ID NO: (1)..(1542)
attgaacttaagagtttgatcctggctcagattgaacgctggcggcatgctttacacatgcaagtcgaacggcagcacgggtgcttgcacctggtggcgagtggcggacgggtgagtaatacatcggaacgtgtccttaagtgggggataacgcatcgaaagatgtgctaataccgcataatatctgaggaagaaagtgggggatcgcaagacctcatgcttttggagcggccgatgtctgattagctagttggtgaggtaatggctcaccaaggcatcgatcagtagttggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctctttcagtcgaaaagaaaaggttgtggctaatatccacaatccatgacggtatcgacagaagaagcaccggctaactacgtgccagcagccgcggtaatacgtagggtgcgagcgttaatcggaattactgggcgtaaagggtgcgcaggcggtcttgtaagtcagatgtgaaatccccgggcttaacctgggaattgcgtttgaaactgtgagactagagtgtagcagaggggggtggaattccatgtgtagcagtgaaatgcgtagagatatggaagaacatcgatggcgaaggcagccccctgggttaacactgacgctcaggcacgaaagcgtggggagcaaacaggattagataccctggtagtccacgccctaaactatgtcaactagttgttgggtcttattagacttggtaacgaagctaacgcgtgaagttgaccgcctggggagtacggtcgcaagattaaaactcaaaggaattgacggggacccgcacaagcggtggattatgtggattaattcgatgcaacgcgaaaaaccttacctacccttgacatgtcaaaaagcattcagagatgagtgtgtgctcgaaagagaatttgaacacaggtgctgcatggctgtcgtcagctcgtgtcgtgagatgttgggttaagtcccgcaacgagcgcaacccttgtcattaattgccatcattaagttgggcactttaatgagactgccggtgataaaccggaggaaggtggggatgacgtcaagtcctcatggcccttatgggtagggcttcacacgtaatacaatggcgcgtacagagggttgccaacccgcgagggggagctaatctcacaaagcgcgtcgtagtccggatcggagtctgcaactcgactccgtgaagtcggaatcgctagtaatcgcggatcagcatgtcgcggtgaatacgttcccgggtcttgtacacaccgcccgtcacaccatgggagtgggtttcaccagaagcaggtagtctaaccgcaaggagggcgcttgccacggtgagattcatgactggggtgaagtcgtaacaaggtagccgtaggggaacctgcggctggatcacctcctttc

SEQ ID NO: 6028 - DNA, 1545 bp, Nitrosomonas sp. Nm120
  ref <308>: DATABASE ACCESSION NUMBER: NCBI ACCESSION: NZ_RCCN01000001.1
  ref <309>: DATABASE ENTRY DATE: 2019-04-01
  ref <313>: RELEVANT RESIDUES IN SEQ ID NO: (1)..(1545)
attaaacttaagagtttgatcctggctcagattgaacgctggcggcatgctttacacatgcaagtcgaacggcagcacgggtgcttgcacctggtggcgagtggcggacgggtgagtaatgcatcggaacgtgtcctgaagtgggggataacgcatcgaaagatgtgctaataccgcatattctctgaggaggaaagtaggggatcgaaagaccttatgcttttggagcggccgatgtctgattagctagttggtggggtaatggcttaccaaggcgacgatcagtagttggtctgagaggacggccagccacactgggactgagacacggcccagactcctacgggaggcagcagtggggaattttggacaatgggcgcaagcctgatccagcaatgccgcgtgagtgaagaaggccttcgggttgtaaagctctttcagttgagaagaaaaagtcgtgactaataatcatgattcatgacggtatcaacagaagaagcaccggctaactacgtgccagcagccgcggtaatacgtagggtgcaagcgttaatcggaattactgggcgtaaagggtgcgcaggcggttctgtaagtcagatgtgaaatccccgggcttaacctgggaactgcgtttgaaactgcagagctagagtgcggcagagggaggtggaattccatgtgtagcagtgaaatgcgtagagatatggaagaacatcgatggcgaaggcaacctcctgggctagcactgacgctcatgcacgaaagcgtggggagcaaacaggattagataccctggtagtccacgccctaaactatgtcaactagttgtcgggtcttattagacttggtaacgtagctaacgcgtgaagttgaccgcctggggagtacggtcgcaagattaaaactcaaaggaattgacggggacccgcacaagcggtggattatgtggattaattcgatgcaacgcgaaaaaccttacctacccttgacatgtcagaaaattttcagagatgaatttgtgcccgaaagggaatctgaacacaggtgctgcatggctgtcgtcagctcgtgtcgtgagatgttgggttaagtcccgcaacgagcgcaacccttgtcattaattgccatcatttagttgggcactttaatgagactgccggtgataaaccggaggaaggtggggatgacgtcaagtcctcatggcccttatgggtagggcttcacacgtaatacaatggcgcgtacagagggttgccaacccgcgagggggagctaatctcagaaagcgcgtcgtagtccggatcggagtctgcaactcgactccgtgaagttggaatcgctagtaatcgcggatcagcatgccgcggtgaatacgttcccgggtcttgtacacaccgcccgtcacaccatgggagtgggtttcaccagaagcaggtagtctaaccgtaaggagggcgcttgccacggtgaggttcatgactggggtgaagtcgtaacaaggtagccgtaggggaacctgcggctggatcacctcctttcaag

SEQ ID NO: 6029 - DNA, 1543 bp, Nitrosospira sp. Nsp44
  ref <308>: DATABASE ACCESSION NUMBER: NCBI ACCESSION: NZ_RBIS01000001.1
  ref <309>: DATABASE ENTRY DATE: 2019-04-01
  ref <313>: RELEVANT RESIDUES IN SEQ ID NO: (1)..(1543)
attaaactgaagagtttgatcctggctcagattgaacgctggcggcatgctttacacatgcaagtcgaacggcagcacgggggcaaccctggtggcgagtggcgaacgggtgagtaatgcatcggaacgtgtccttaagtgggggataacgcaccgaaaggtgtgctaataccgcataatctctacggagaaaagcaggggatcgcaagaccttgcgcttttggagcggccgatgtctgattagctagttggtgaggtaaaggcttaccaaggcgtcgatcagtagctggtctgagaggacgaccagccacactgggactgagacacggcccagactcctacgggaggcagcagtggggaattttggacaatgggggaaaccctgatccagccatgccgcgtgagtgaagaaggccttcgggttgtaaagctctttcagccggaacgaaacggtcacggctaatacctgtgactactgacggtaccggaagaagaagcaccggctaactacgtgccagcagccgcggtaatacgtagggtgcaagcgttaatcggaattactgggcgtaaagcgtgcgcaggcggttttgtaagtcagatgtgaaatccccgggcttaacctgggaactgcgtttgaaactacaaggctagagtgtggcagaggggggtggaattccacgtgtagcagtgaaatgcgtagagatgtggaggaacaccgatggcgaaggcagccccctgggttaacactgacgctcaggcacgaaagcgtggggagcaaacaggattagataccctggtagtccacgccctaaacgatgtcaactagttgtcgggtcttaacggacttggtaacgcagctaacgcgtgaagttgaccgcctggggagtacggtcgcaagattaaaactcaaaggaattgacggggacccgcacaagcggtggattatgtggattaattcgatgcaacgcgaaaaaccttacctacccttgacatgtaccgaagcccgccgagaggtgggcgtgcccgaaagggagcggtaacacaggtgctgcatggctgtcgtcagctcgtgtcgtgagatgttgggttaagtcccgcaacgagcgcaacccttgtcattaattgccatcattcagttgggcactttaatgaaactgccggtgacaaaccggaggaaggtggggatgacgtcaagtcctcatggcccttatgggtagggcttcacacgtaatacaatggcgcgtacagagggttgccaacccgcgagggggagctaatctcagaaagcgcgtcgtagtccggatcggagtctgcaactcgactccgtgaagtcggaatcgctagtaatcgcggatcagcatgtcgcggtgaatacgttcccgggtcttgtacacaccgcccgtcacaccatgggagtgggttccaccagaagcaggtagtctaaccgcaaggagggcgcctgccacggtgagattcatgactggggtgaagtcgtaacaaggtagccgtaggggaacctgcggctggatcacctcctttcaag

SEQ ID NO: 6030 - DNA, 1543 bp, Nitrosovibrio sp. Nv12
  ref <308>: DATABASE ACCESSION NUMBER: NCBI ACCESSION: NZ_RCCG01000002.1
  ref <309>: DATABASE ENTRY DATE: 2019-04-01
  ref <313>: RELEVANT RESIDUES IN SEQ ID NO: (1)..(1543)
attgaactgaagagtttgatcctggctcagattgaacgctggcggcatgctttacacatgcaagtcgaacggcagcacgggggcaaccctggtggcgagtggcgaacgggtgagtaatgcatcggaacgtatcttcaagtgggggataacgcaccgaaaggtgtgctaataccgcataatctctacggagaaaagcaggggatcgcaagaccttgcgcttttggagcggccgatgtctgattagctagttggtgaggtaaaggcttaccaaggcgtcgatcagtagctggtctgagaggacgaccagccacactgggactgagacacggcccagactcctacgggaggcagcagtggggaattttggacaatgggggaaaccctgatccagccatgccgcgtgagtgaagaaggccttcgggttgtaaagctctttcagccggaacgaaacggtcacggttaatacctgtgatcactgacggtaccggaagaagaagcaccggctaactacgtgccagcagccgcggtaatacgtagggtgcaagcgttaatcggaattactgggcgtaaagcgtgcgcaggcggttttgtaagtcagatgtgaaatccccgggcttaacctgggaactgcgtttgaaactacaaggctagagtgtagcagaggggggtggaattccacgtgtagcagtgaaatgcgtagagatgtggaggaacaccgatggcgaaggcagccccctgggttaacactgacgctcaggcacgaaagcgtggggagcaaacaggattagataccctggtagtccacgccctaaactatgtcaactagttgtcgggccttaacgggcttggtaacgcagctaacgcgtgaagttgaccgcctggggagtacggtcgcaagattaaaactcaaaggaattgacggggacccgcacaagcggtggattatgtggattaattcgatgcaacgcgaaaaaccttacctacccttgacatgtaccgaagcccgccgagaggtgggtgtgcccgaaagggaacggtaacacaggtgctgcatggctgtcgtcagctcgtgtcgtgagatgttgggttaagtcccgcaacgagcgcaacccttgtcattaattgccatcattcagttgggcactttaatgaaactgccggtgacaaaccggaggaaggtggggatgacgtcaagtcctcatggcccttatgggtagggcttcacacgtaatacaatggcgcgtacagagggttgccaacccgcgagggggagccaatctcagaaagcgcgtcgtagtccggatcggagtctgcaactcgactccgtgaagtcggaatcgctagtaatcgcggatcagcatgtcgcggtgaatacgttcccgggtcttgtacacaccgcccgtcacaccatgggagtgggtttcaccagaagcaggtagtctaaccgcaaggagggcgcctgccacggtgagattcatgactggggtgaagtcgtaacaaggtagccgtaggggaacctgcggctggatcacctcctttctag

SEQ ID NO: 6031 - DNA, 1526 bp, Nitrospina gracilis
  ref <308>: DATABASE ACCESSION NUMBER: NCBI ACCESSION: NZ_HG422173.1
  ref <309>: DATABASE ENTRY DATE: 2019-04-01
  ref <313>: RELEVANT RESIDUES IN SEQ ID NO: (1)..(1526)
aactggagagtttgatcctggctcagaacgaacgctggcggcgtgcctaacacatgcaagtcgaacgagaaagttccttcgggaatgagtaaagtggcgcaagggtgagtaacacgtgaataatctgcctttgagattgggataacctgacgaaagttaggctaataccgaataagaccacgtctcataagagatgcggtaaaaggagtctcaaactccactcaaagatgagttcgcggaccattagctagttggtgagataaaagctcaccaaggctacgatggttagccggcctgagagggtgatcggccacactggaactgagacacggtccagactcctacgggaggcagcagtggggaattttgcgcaatgggcgaaagcctgacgcagcaacgccgcgtgagcgatgaaggccttcgggtcgtaaagctctgtcgggtgggaagaacacaatgacggtaccaccaaaggaagccccggctaactccgtgccagcagccgcggtaacacggagggggcgagcgttgttcggaatcattgggcgtaaagcgtatgtaggtggccggataagtcagacgtgtaagcccacggctcaaccgtggaattgcgtttgaaactattcggcttgagtgcaggagaggaaagcggaatttccagtgtagcggtgaaatgcgttgatattgggaagaacaccagtggcgaaggcggctttctggcctgcaactgacactgagatacgaaagccaggggagcgaacgggattagataccccggtagtcctggctgtaaacgatgggcactaggtgtaggaggtgttgatcccttctgtgccgcagctaacgcattaagtgccccgcctggggagtacggtcgcaaggctgaaactcaaaggaattgacgggggcccgcacaagcggtggagcatgtggtttaattcgacgcaacgcgaagaaccttacctggatttgacttgcttgggaccgccttggaaacaaggtttcccttcggggcccttgcacaggtgctgcatggctgtcgtcagctcgtgtcgtgagatgttgggttaagttccgcaacgagcgcaacccctacctttagttgccagcgggtaatgccgggaactctaaaggaactgtcggtgataaaccggaggaaggtggggatgacgtcaagtcctcatggcctttatgtccagggctacacacgtgctacaatggccggtacaaagagttgcaataccgcgaggtggagctaatctcaaaaagccggtctcagttcggattggagtctgcaactcgactccatgaagctggaatcgctagtaatcgtggatcagcatgccacggtgaatacgttcccgggccttgtacacaccgcccgtcacaccatgaaagccgactgtaccagaagtcacgatgctaaccttcggggagctactgcctaaggtatggttggtgatcggggtgaagtcgtaacaaggtagccgtaggggaacctgcggctggatcacctcctttctaag

SEQ ID NO: 6032 - DNA, 1533 bp, Nitrospira defluvii
  ref <308>: DATABASE ACCESSION NUMBER: NCBI ACCESSION: NC_014355.1
  ref <309>: DATABASE ENTRY DATE: 2019-04-01
  ref <313>: RELEVANT RESIDUES IN SEQ ID NO: (1)..(1533)
gagagtttgatcctggctcagaacgaacgctggcggcgcgcctaatacatgcaagtcgagcgagaaggtgtagcaatacacttgtaaagcggcgaacgggtgaggaatacatgggtaatctaccatcgagtggggaataaccagccgaaaggttggctaataccgcgtacgcctccgaatcttcgggttcggagggaaagccacactgtgagtgcggcgctctttgatgagctcatgtcctatcagcttgttggtagggtaacggcctaccaaggctttgacgggtagctggtctgagaggacgatcagccacactggcactgcgacacgggccagactcctacgggaggcagcagtaaggaatattgcgcaatgggcgaaagcctgacgcagcgacgccgcgtgggggatgaaggtcttcggattgtaaacccctttcgggagggaagatggagcgagcaatcgttcggacggtacctccagaagcagccacggccaacttcgtgccagcagccgcggtaatacgaaggtggcaagcgttgttcggattcactgggcgtacagggtgtgtaggcggtttggtaagccttctgttaaagcttcgggcccaacccggaaagcgcagagggtactgccaggctagagggtgggagaggagcgcggaattcccggtgtagcggtgaaatgcgtagagatcgggaggaaggccggtggcgaaggcggcgctctggaacatacctgacgctgagacacgaaagcgtggggagcaaacaggattagataccctggtagtccacgccctaaactatggatactaagtgtcggcgggttaccgccggtgccgcagctaacgcattaagtatcccgcctgggaagtacggccgcaaggttgaaactcaaaggaattgacgggggcccgcacaagcggtggagcatgtggtttaattcgacgcaacgcgaagaaccttacccaggttggacatgcacgtagtagaaaggtgaaagcctgacgaggtagcaataccagcgtgctcaggtgctgcatggctgtcgtcagctcgtgccgtgaggtgttgggttaagtcccgcaacgagcgcaacccctgctttcagttgctaccgggtcatgccgagcactctgaaaggactgcccaggataacggggaggaaggtggggatgacgtcaagtcagcatggcctttatgcctggggccacacacgtgctacaatggccggtacaaagcgctgcaaacctgcaaaggggagccaatcgcaaaaaaccggcctcagttcagattgaggtctgcaactcgacctcatgaaggcggaatcgctagtaatcgcggatcagcacgccgcggtgaatacgttcccgggccttgtacacaccgcccgtcacaccacgaaagcctgttgtacctgaagtcgcccaagccaaccgcaaggaggcaggcgcccacggtatggccggtgattggggtgaagtcgtaacaaggtagccgtaggggaacctgcggctggatcacctccttt

SEQ ID NO: 6033 - DNA, 1539 bp, Nitrospira japonica
  ref <308>: DATABASE ACCESSION NUMBER: NCBI ACCESSION: NZ_LT828648.1
  ref <309>: DATABASE ENTRY DATE: 2019-04-01
  ref <313>: RELEVANT RESIDUES IN SEQ ID NO: (1)..(1539)
gagagtttgatcctggctcagaacgaacgctggcggcgcgcctaatacatgcaagtcgaacgagaatgtgtagcaatacacatgtacagtggcgaacgggtgaggactacatgggtaacctaccctcgagtggggaataactagccgaaaggttagctaataccgcgtacgcctcccggactgcggttcgggggggaaagcgataccgtgggtatcgcgctcttggatgggctcatgccctatcagcttgttggtgaggtaacggctcaccaaggcatcgacgggtagctgatctgagaggatgatcagccacactggcactgcgacacgggccagactcctacgggaggcagcagtaaggaatattgcgcaatgggcgaaagcctgacgcagcgacgccgcgtgggggatgaaggtcttcggattgtaaacccctttcgggagggaagatgggatagggtaacctatccggacggtacctccagaagcagccacggctaacttcgtgccagcagccgcggtaatacgaaggtggcaagcgttgttcggatttactgggcgtacagggagcgtaggcggttggataagccctccgtgaaatctccaggcttaacctggaaagtgcagaggggactgttcagctagaggatgggagaggagcgcggaattcccggtgtagcggtgaaatgcgtagagatcgggaggaaggccggtggcgaaggcggcgctctggaacatttctgacgctgaggctcgaaagcgtggggagcaaacaggattagataccctggtagtccacgccttaaacgatggatactaagtgtcggcgggttaccgccggtgccgcagctaacgcagtaagtatcccgcctgggaagtacggccgcaaggttgaaactcaaaggaattgacgggggcccgcacaagcggtggagcatgtggtttaattcgacgcaacgcgaagaaccttacccaggctggacatgcaggtagtagaagggtgaaagcctaacgaggtagcaataccatcctgctcaggtgctgcatggctgtcgtcagctcgtgccgtgaggtgttgggttaagtcccgcaacgagcgcaacccctgtcttcagttactaacgggtcaagccgagaactctggagagactgcccaggagaacggggaggaaggtggggatgacgtcaagtcagcatggcctttatgcctggggccacacacgtgctacaatggccggtacaaagggctgcaaacccgtgagggggagccaatcccaaaaaaccggcctcagttcagatcgaggtctgcaactcgacctcgtgaaggcggaatcgctagtaatcccggatcagcacgccggggtgaatacgttcccgggccttgtacacaccgcccgtcacaccacgaaagtttgttgtacctgaagtcgttggcgccaaccgcaaggaggcagacgcccacggtatgaccgatgattggggtgaagtcgtaacaaggtagccgtaggggaacctgcggctggatcacctcctttctaa

SEQ ID NO: 6034 - DNA, 1546 bp, Nitrospira lenta
  ref <308>: DATABASE ACCESSION NUMBER: NCBI ACCESSION: NZ_OUNR01000021.1
  ref <309>: DATABASE ENTRY DATE: 2019-04-01
  ref <313>: RELEVANT RESIDUES IN SEQ ID NO: (1)..(1546)
gaacacctatttgagagtttgatcctggctcagaacgaacgctggcggcgcgcctaatacatgcaagtcgagcgagaaggtgtagcaatacacttgtaaagcggcgaacgggtgaggaatgcatgggtaacctaccctcgagtggggaataactagccgaaaggttagctaataccgcatacgtttccggaacttcggtttcggaaagaaagcaataccgtgggtattgcgctcatggatgggctcatgtcctatcagcttgttggtgaggtaacggctcaccaaggcttcgacgggtagctggtctgagaggacgatcagccacactggcactgcgacacgggccagactcctacgggaggcagcagtaaggaatattgcgcaatggacgaaagtctgacgcagcgacgccgcgtgggggatgaaggtcttcggattgtaaacccctttcgggagggaagatggagtgggtaaccacttggacggtacctccagaagcagccacggctaacttcgtgccagcagccgcggtaatacgaaggtggcaagcgttgttcggattcactgggcgtacagggagcgtaggcggttgggtaagccctccgtgaaatctccgggcctaacccggaaagtgcagaggggactgctcagctagaggatgggagaggagcgcggaattcccggtgtagcggtgaaatgcgtagagatcgggaggaaggccggtggcgaaggcggcgctctggaacatttctgacgctgaggctcgaaagcgtggggagcaaacaggattagataccctggtagtccacgccttaaactatggatactaagtgtcggcggtttaccgccggtgccgcagctaacgcaataagtatcccgcctgggaagtacggccgcaaggttgaaactcaaaggaattgacgggggcccgcacaagcggtggagcatgtggtttaattcgacgcaacgcgaagaaccttacccaggctggacatgcaggtagtagaagggtgaaagcccaacgaggtagaaataccatcctgctcaggtgctgcatggctgtcgtcagctcgtgccgtgaggtgttgggttaagtcccgcaacgagcgcaacccctgtcttcagttactaacaggtcaagctgagaactctggagagactgcccaggagaacggggaggaaggtggggatgacgtcaagtcagcatggcctttatgcctggggctacacacgtgctacaatggccggtacaaagggctgcaaacccgcaagggggagccaatcccaaaaaaccggcctcagttcagattggggtctgcaactcgaccccatgaaggcggaatcgctagtaatcgcggatcagaacgccgcggtgaatacgttcccgggccttgtacacaccgcccgtcacaccacgaaagtttgttgtacctgaagtcgttgcgccaaccgcaaggaggcaggcgcccacggtatgaccgatgattggggtgaagtcgtaacaaggtagccgtaggggaacctgcggctggatcacctcctttct

SEQ ID NO: 6035 - DNA, 1535 bp, Nitrospira moscoviensis
  ref <308>: DATABASE ACCESSION NUMBER: NCBI ACCESSION: NZ_CP011801.1
  ref <309>: DATABASE ENTRY DATE: 2019-04-01
  ref <313>: RELEVANT RESIDUES IN SEQ ID NO: (1)..(1535)
gagagtttgatcctggctcagaacgaacgctggcggcgcgcctaatacatgcaagtcgagcgagaaggcgtagcaatacgcttgtaaagcggcgaacgggtgaggaatacatgggtaacctaccctcgagtggggaataaccagccgaaaggttggctaataccgcatacgattcccggactgcggttcgggaaagaaagcgttaccgtgggtagcgcgctcttggatgggctcatgtcctatcagcttgttggtgaggtaacggctcaccaaggcttcgacgggtagctggtctgagaggacgatcagccacactggcactgcgacacgggccagactcctacgggaggcagcagtaaggaatattgcgcaatgggcgaaagcctgacgcagcgacgccgcgtgggggatgaaggtcttcggattgtaaacccctttcgggagggaagatggaacgggtaaccgttcggacggtacctccagaagcagccacggctaacttcgtgccagcagccgcggtaatacgaaggtggcaagcgttgttcggattcactgggcgtacagggagcgtaggcggttgggtaagccctccgtgaaatctccgggcctaacccggaaagtgcagaggggactgctcggcttgaggatgggagaggagcgcggaattcccggtgtagcggtgaaatgcgtagagatcgggaggaaggccggtggcgaaggcggcgctctggaacatttctgacgctgaggctcgaaagcgtggggagcaaacaggattagataccctggtagtccacgccttaaactatggatactaagtgtcggcgggttaccgccggtgccgcagctaacgcagtaagtatcccgcctgggaagtacggccgcaaggttgaaactcaaaggaattgacgggggcccgcacaagcggtggagcatgtggtttaattcgacgcaacgcgaagaaccttacccaggctggacatgcacgtagtaggaggatgaaagtccgacgaggtagcaataccagcgtgctcaggtgctgcatggctgtcgtcagctcgtgccgtgaggtgttgggttaagtcccgcaacgagcgcaacccctgtcttcagttaccaccgggtcatgccgggaactctggagagactgcccaggagaacggggaggaaggtggggatgacgtcaagtcagcatggcctttatgcctggggccacacacgtgctacaatggccggcacaaagagctgcaaacccgtgagggggagccaatctcaaaaaaccggcctcagttcagattgaggtctgcaactcgacctcatgaaggcggaatcgctagtaatcgcggatcagcacgccgcggtgaatacgttcccgggccttgtacacaccgcccgtcacaccacgaaagtttgttgtacctgaagtcgtcgacgccaaccgcaagggggcaggcgcccacggtatgaccgatgattggggtgaagtcgtaacaaggtagccgtaggggaacctgcggctggatcacctcctttct

SEQ ID NO: 6036 - DNA, 1533 bp, Nitrospira sp. ND1
  ref <308>: DATABASE ACCESSION NUMBER: NCBI ACCESSION: NZ_FWEX01000006.1
  ref <309>: DATABASE ENTRY DATE: 2019-04-01
  ref <313>: RELEVANT RESIDUES IN SEQ ID NO: (1)..(1533)
gagagtttgatcctggctcagaacgaacgctggcggcgcgcctaatacatgcaagtcgagcgagaaggtgtagcaatacacttgtaaagcggcgaacgggtgaggaatacatgggtaatctaccatcgagtggggaataaccagccgaaaggttggctaataccgcgtacgcctccggatcttcgggttcggagggaaagccacactgtgagtgcggcgctctttgatgagctcatgtcctatcagcttgttggtagggtaacggcctaccaaggctttgacgggtagctggtctgagaggacgatcagccacactggcactgcgacacgggccagactcctacgggaggcagcagtaaggaatattgcgcaatgggcgaaagcctgacgcagcgacgccgcgtgggggatgaaggtcttcggattgtaaacccctttcgggagggaagatggagcgagcaatcgttcggacggtacctccagaagcagccacggccaacttcgtgccagcagccgcggtaatacgaaggtggcaagcgttgttcggattcactgggcgtacagggtgtgtaggcggtttggtaagccttctgttaaagcttcgggcccaacccggaaagcgcagagggtactgccaggctagagggtgggagaggagcgcggaattcccggtgtagcggtgaaatgcgtagagatcgggaggaaggccggtggcgaaggcggcgctctggaacatacctgacgctgagacacgaaagcgtggggagcaaacaggattagataccctggtagtccacgccctaaactatggatactaagtgtcggcgggttaccgccggtgccgcagctaacgcattaagtatcccgcctgggaagtacggccgcaaggttgaaactcaaaggaattgacgggggcccgcacaagcggtggagcatgtggtttaattcgacgcaacgcgaagaaccttacccaggttggacatgcacgtagtagaaaggtgaaagcctgacgaggtagcaataccagcgtgctcaggtgctgcatggctgtcgtcagctcgtgccgtgaggtgttgggttaagtcccgcaacgagcgcaacccctgctttcagttgctaccgggtcatgccgagcactctgaaaggactgcccaggataacggggaggaaggtggggatgacgtcaagtcagcatggcctttatgcctggggccacacacgtgctacaatggccggtacaaagcgctgcaaacctgcgagggggagccaatcgcaaaaaaccggcctcagttcagattgaggtctgcaactcgacctcatgaaggcggaatcgctagtaatcgcggatcagcacgccgcggtgaatacgttcccgggccttgtacacaccgcccgtcacaccacgaaagcctgttgtacctgaagtcgcccaagccaaccgcaaggaggcaggcgcccacggtatggccggtgattggggtgaagtcgtaacaaggtagccgtaggggaacctgcggctggatcacctccttt

SEQ ID NO: 6037 - DNA, 1531 bp, Nitrospirae bacterium HCH-1
  ref <308>: DATABASE ACCESSION NUMBER: NCBI ACCESSION: NZ_LNQR01000045.1
  ref <309>: DATABASE ENTRY DATE: 2019-04-01
  ref <313>: RELEVANT RESIDUES IN SEQ ID NO: (1)..(1531)
aaactgagagtttgatcctggctcagagcgaacgctggcggcgtgcttaacacatgcaagtcatacggagttatggaggggtaacctgacataactaagtggcggacgggtgagtaacgcgtaggtgacctgcccttgtgactgggataaccactggaaacggtggataataccggataagcccacgattaggtgatagtagtgggaaaaggagaaatctgcacaaggatgggcctgcgtcctatcaggtagttggtaaggtaaaggcttaccaagcctaagacgggtagccggtctgagaggatggacggccacactggaactgagacacggtccagactcctacgggaggcagcagtgaggaattttgcgcaatgggcgaaagcctgacgcagcgacgccgcgtgggggatgaaggccttcgggttgtaaaccccttttgtaagggaagatagtgacggtaccttaagaataagccacggctaactctgtgccagcagccgcggtaagacagaggtggcaagcgttgctcggaatcactgggcttaaagggcgcgtaggcggttaatcaagtttagggtggaatgcatgggctcaacctgtgaattgccttgaaaactggttgacttgagtaagcgaggggatggcggaattcctggtgtagcggtgaaatgcgtagatatcaggaggaaggccggtggcgaaggcggccatctggcgcttaactgacgctgaggcgcgaaagcgtggggatcaaacaggattagataccctggtagtccacgccctaaacggtgggtactaggtgtagggctctttagggttctgtgccgaagggaaaccgataagtaccccgcctgggaagtacggccgcaaggttgaaactcaaaggaattgacgggggcccgcacaagcggtggagcatgtggtttaattcgacgcaacgcgaagaaccttacctgggtttgacatgcagatggtagtgatccgaaaggtgagcgactttcccgtaagggagagagtctgcacaggtgctgcatggctgtcgtcagctcgtgccgtgaggtgttgggttaagtcccgcaacgagcgcaacccctatcctttgttgccatcaggttaagctgggcactctaaggaaactgccggcgatgagttggaggaaggtggggacgacgtcaagtcatcatggcccttatatccagggctacacacgtgctacaatggttattacagagggaagcaatgccgcgaggtggagcaaatccccaaaaatattcgtagttgggatcggagtctgcaactcgactccgtgaacgtggaatcgctagtaatcgcagatcagctacgctgcggtgaatacgttcccgggccttgtacacaccgcccgtcacaccacgaaagtctgctgtacccgaagagggtgagctaaccagcaatggaggcagctcgctaaggtatggtaggtaattggggtgaagtcgtaacaaggtagccgtaggggaacctgcggctggatcacctcctttct

SEQ ID NO: 6038 - DNA, 1484 bp, Niveispirillum cyanobacteriorum
  ref <308>: DATABASE ACCESSION NUMBER: NCBI ACCESSION: NZ_CP025611.1
  ref <309>: DATABASE ENTRY DATE: 2019-04-01
  ref <313>: RELEVANT RESIDUES IN SEQ ID NO: (1)..(1484)
aaacctgagagtttgatcctggctcagaacgaacgctggcggcaggcctaacacatgcaagtcgaacgcaccgcaaggtgagtggcgcacgggtgagtaacacgtgggaatgtaccctttggttcggaataacgtttggaaacgaacgctaataccggatgagccctacgggggaaagatttatcgccaaaggagcagcccgcgtctgattagctagttggtggggtaaaggcctaccaaggcgacgatcagtagctggtctgagaggatgatcagccacactgggactgagacacggcccagactcctacgggaggcagcagtggggaatattggacaatgggcggaagcctgatccagccatgccgcgtgagtgatgaaggccttcgggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcttatcaagtcaggcgtgaaagccccgggcttaacctgggaactgcgcttgagactggtaggctagagtaccggagaggtaggtggaattcccagtgtagaggtgaaattcgtagatattgggaagaacaccagtggcgaaggcggcctactggacggtaactgacgctgaggcgcgaaagcgtggggagcaaacaggattagataccctggtagtccacgctgtaaacgatgtcggctagacgttggggttcttagaacttcggtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccaacccttgacatgccttgaccgccacagagatgtggttttcctttcggggacagggacacaggtgctgcatggctgtcgtcagctcgtgtcgtgagatgttgggttaagtcccgcaacgagcgcaacccccactgttagttgccatcatttagttgggcactctagcagaactgccggtgacaagccggaggaaggcggggatgacgtcaagtcctcatggcccttacgggttgggctacacacgtgctacaatggtggtgacagtgggcagcgaccacgcgagtggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacctgaagccggtgcgctaaccgcaaggaggcagccgaccacggtacggtcagcgactggggtgaagtcgtaacaaggtagccgtaggggaacctgcggctggatcacctcctttcta

SEQ ID NO: 6039 - DNA, 1484 bp, Niveispirillum lacus
  ref <308>: DATABASE ACCESSION NUMBER: NCBI ACCESSION: NZ_NOXU01000016.1
  ref <309>: DATABASE ENTRY DATE: 2019-04-01
  ref <313>: RELEVANT RESIDUES IN SEQ ID NO: (1)..(1484)
aaacctgagagtttgatcctggctcagaacgaacgctggcggcaggcctaacacatgcaagtcgaacgcatcgcaagatgagtggcgcacgggtgagtaacacgtgggaatgtaccctttggttcggaataacgtttggaaacggacgctaataccggatgagccctgcgggggaaagatttatcgccaaaggagcagcccgcgtctgattagctagttggtggggtaaaggcctaccaaggcgacgatcagtagctggtctgagaggatgatcagccacactgggactgagacacggcccagactcctacgggaggcagcagtggggaatattggacaatgggcggaagcctgatccagccatgccgcgtgagtgatgaaggccttcgggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggctttgtcagtcaggcgtgaaagccccgggcttaacctgggaactgcgcttgatactgcaaggctagagtaccggagaggtaggtggaattcccagtgtagaggtgaaattcgtagatattgggaagaacaccagtggcgaaggcggcctactggacggtaactgacgctgaggcgcgaaagcgtggggagcaaacaggattagataccctggtagtccacgccgtaaacgatgtcggctagacgttggtgctcttagagcttcagtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccaacccttgacatgccttgaccggtgcagagatgcacttttcctttcggggacagggacacaggtgctgcatggctgtcgtcagctcgtgtcgtgagatgttgggttaagtcccgcaacgagcgcaacccccactgttagttgccagcattgagttgggcactctagcagaactgccggtgacaagccggaggaaggcggggatgacgtcaagtcctcatggcccttacgggttgggctacacacgtgctacaatggtggtgacagtgggcagcgaccacgcgagtggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacctgaagccggtgcgctaaccgcaaggaggcagccgaccacggtacggtcagcgactggggtgaagtcgtaacaaggtagccgtaggggaacctgcggctggatcacctcctttcta

SEQ ID NO: 6040 - DNA, 1516 bp, Nocardia africana
  ref <308>: DATABASE ACCESSION NUMBER: NCBI ACCESSION: NZ_UGRU01000001.1
  ref <309>: DATABASE ENTRY DATE: 2019-04-01
  ref <313>: RELEVANT RESIDUES IN SEQ ID NO: (1)..(1516)
ggagagtttgatcctggctcaggacgaacgctggcggcgtgcttaacacatgcaagtcgagcggtaaggcccttcggggtacacgagcggcgaacgggtgagtaacacgtgggtgatctgcctcgtactctgggataagcctgggaaactgggtctaataccggatatgaccacgaatcgcatggtttgtggtggaaagatttatcggtgcgagatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggttcgtcgcgtcgatcgtgaaaacttgcagctcaactgcgagcttgcggtcgatacgggcggactagagtactgcaggggagactggaattcctggtgtagcggtgaaatgcgcagatatcaggaggaacaccggtggcgaaggcgggtctctgggcagtaactgacgctgagaagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccagaaagccgtagagatacggccccccttgtggttggtgtacaggtggtgcatggctgtcgtcagctcgtgtcgtgagatgttgggttaagtcccgcaacgagcgcaacccttgtcctgtgttgccagcgcgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 6041 - DNA, 1516 bp, Nocardia asteroides
  ref <308>: DATABASE ACCESSION NUMBER: NCBI ACCESSION: NZ_LR134352.1
  ref <309>: DATABASE ENTRY DATE: 2019-04-01
  ref <313>: RELEVANT RESIDUES IN SEQ ID NO: (1)..(1516)
ggagagtttgatcctggctcaggacgaacgctggcggcgtgcttaacacatgcaagtcgagcggtaaggcccttcggggtacacgagcggcgaacgggtgagtaacacgtgggtgatctgcctcgtacttcgggataagcctgggaaactgggtctaataccggatatgaccttcggatgcatgtctgagggtggaaagatttatcggtacgagatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggttcgtcgcgtcgttcgtgaaaacttggggctcaaccccaagcttgcgggcgatacgggcggactagagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 6042 - DNA, 1517 bp, Nocardia seriolae
  ref <308>: DATABASE ACCESSION NUMBER: NCBI ACCESSION: NZ_RCNK01000277.1
  ref <309>: DATABASE ENTRY DATE: 2019-04-01
  ref <313>: RELEVANT RESIDUES IN SEQ ID NO: (1)..(1517)
ggagagtttgatcctggctcaggacgaacgctggcggcgtgcttaacacatgcaagtcgagcggtaaggcccttcggggtacacgagcggcgaacgggtgagtaacacgtgggtgatctgccttgcactctgggataagcctgggaaactgggtctaataccggatatgagcctgaactgcatggttcgggttggaaagatttatcggtgcgagatgggcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggctaactacgtgccagcagccgcggtaatacgtagggtgcgagcgttgtccggaatgactgggcgtaaagagcttgtaggcggtctgtcacgtcggtcgtgaaaactcacagctcaactgtgggcctgcggtcgatacgggcagactagagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaagccgtagagatacggcccccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggattggcgattgggacgaagtcgtaacaaggtagccgtaccggaaggtgcggctggatcacctcctttctaa

SEQ ID NO: 6043 - DNA, 1518 bp, Nocardia sp. CFHS0054
  ref <308>: DATABASE ACCESSION NUMBER: NCBI ACCESSION: NZ_CP032568.1
  ref <309>: DATABASE ENTRY DATE: 2019-04-01
  ref <313>: RELEVANT RESIDUES IN SEQ ID NO: (1)..(1518)
ggagagtttgatcctggctcaggacgaacgctggcggcgtgcttaacacatgcaagtcgagcggtaaggcccttcggggtacacgagcggcgaacgggtgagtaacacgtgggtgatctgcctcgcactctgggataagcctgggaaactgggtctaataccggatatgagcagccttcgcatgggggttgttggaaaggtttactggtgcgagatgggcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggctaactacgtgccagcagccgcggtaatacgtagggtgcgagcgttgtccggaattactgggcgtaaagagcttgtaggcggtctgtcacgtcgattgtgaaacctcgcggctcaaccgcgggcctgcagtcgatacgggcagactagagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaagctgcagagatgcagccccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggattggcgattgggacgaagtcgtaacaaggtagccgtaccggaaggtgcggctggatcacctcctttctaa

SEQ ID NO: 6044 - DNA, 1517 bp, Nocardia sp. FDAARGOS 372
  ref <308>: DATABASE ACCESSION NUMBER: NCBI ACCESSION: NZ_PDDW01000001.1
  ref <309>: DATABASE ENTRY DATE: 2019-04-01
  ref <313>: RELEVANT RESIDUES IN SEQ ID NO: (1)..(1517)
ggagagtttgatcctggctcaggacgaacgctggcggcgtgcttaacacatgcaagtcgagcggtaaggcccttcggggtacacgagcggcgaacgggtgagtaacacgtgggtgatctgccctgtacttcgggataagcctgggaaactgggtctaataccggatatgaccttacatcgcatggtgtttggtggaaagatttatcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggtttgtcgcgtcgtccgtgaaaacttggggctcaaccccaagcttgcgggcgatacgggcagacttgagtactgcaggggagactggaattcctggtgtagcggtgaaatgcgcagatatcaggaggaacaccggtggcgaaggcgggtctctgggcagtaactgacgctgagaagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggccccttgtggtcggtgtacaggtggtgcatggctgtcgtcagctcgtgtcgtgagatgttgggttaagtcccgcaacgagcgcaacccttgtcctgtgttgccagcgcgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 6045 - DNA, 1516 bp, Nocardia sp. NEAU-LL90
  ref <308>: DATABASE ACCESSION NUMBER: NCBI ACCESSION: NZ_RFFH01000046.1
  ref <309>: DATABASE ENTRY DATE: 2019-04-01
  ref <313>: RELEVANT RESIDUES IN SEQ ID NO: (1)..(1516)
ggagagtttgatcctggctcaggacgaacgctggcggcgtgcttaacacatgcaagtcgagcggtaaggcccttcggggtacacgagcggcgaacgggtgagtaacacgtgggtgatctgcctcgcactctgggataagcctgggaaactgggtctaataccggatatgagccgggaatgcatgttcctggttggaaaggtttactggtgcgagatgggcccgcggcctatcagcttgttggtggggtaacggcccaccaaggcgacgacgggtagccggcctgagagggcgaacggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgaaagtgacggtacctgtataagaagcaccggccaactacgtgccagcagccgcggtaatacgtagggtgcgagcgttgtccggaattactgggcgtaaagagcttgtaggcggttcgtcgcgtcgatcgtgaaaacttgcagctcaactgcgagcttgcggtcgatacgggcggactagagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaagccatagagatatggccccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggattggcgattgggacgaagtcgtaacaaggtagccgtaccggaaggtgcggctggatcacctcctttctaa

SEQ ID NO: 6046 - DNA, 1517 bp, Nocardia sp. YIM PH 21724
  ref <308>: DATABASE ACCESSION NUMBER: NCBI ACCESSION: NZ_QZFU01000027.1
  ref <309>: DATABASE ENTRY DATE: 2019-04-01
  ref <313>: RELEVANT RESIDUES IN SEQ ID NO: (1)..(1517)
ggagagtttgatcctggctcaggacgaacgctggcggcgtgcttaacacatgcaagtcgagcggtaaggcccttcggggtacacgagcggcgaacgggtgagtaacacgtgggtgatctgccccgtacttcgggataagcccgggaaactgggtctaataccggatatgaccatggcctgcatgggttgtggtggaaagatttatcggtacgggatgggcccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcggaagcctgatgcagcgacgccgcgtgagggatgacggccttcgggttgtaaacctctttcgacagggacgaagcgtgagtgacggtacctgtagaagaagcaccggccaactacgtgccagcagccgcggtaatacgtagggtgcgagcgttgtccggaattactgggcgtaaagagcttgtaggcggcttgtcgcgtcgatcgtgaaaactcggggctcaactccgagcttgcggtcgatacgggcaggcttgagtactgcaggggagactggaattcctggtgtagcggtgaaatgcgcagatatcaggaggaacaccggtggcgaaggcgggtctctgggcagtaactgacgctgagaagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccgctggcctaacccgtaagggagggaggcgtcgaaggtgggatcggcgattgggacgaagtcgtaacaaggtagccgtaccggaaggtgcggctggatcacctcctttctaa

SEQ ID NO: 6047 - DNA, 1525 bp, Nocardioides baekrokdamisoli
  ref <308>: DATABASE ACCESSION NUMBER: NCBI ACCESSION: NZ_AP019307.1
  ref <309>: DATABASE ENTRY DATE: 2019-04-01
  ref <313>: RELEVANT RESIDUES IN SEQ ID NO: (1)..(1525)
tttggagagtttgatcctggctcaggacgaacgctggcggcgtgcttaacacatgcaagtcgagcggaaaggcctttcggggtactcgagcggcgaacgggtgagtaacacgtgagtaatctgccctgcactctgggatagccatcggaaacggtgattaatactggatatgagcaatccacgcatgtgggttgttggaaagtttttcggtgcaggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagtacagacgaagcgcaagtgacggtatgtacagaagaaggaccggccaactacgtgccagcagccgcggtaatacgtagggtccgagcgttgtccggaattattgggcgtaaagggctcgtaggcggtttgtcgcgtcgggagtgaaaacttcgggcttaactcggagcttgctttcgatacgggcagacttgaggcattcaggggagaacggaattcctggtgtagcggtgaaatgcgcagatatcaggaggaacaccggtggcgaaggcggttctctgggaatgtactgacgctgaggagcgaaagtgtggggagcgaacaggattagataccctggtagtccacaccgtaaacgttgggcgctaggtgtggggcctattccatgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatgcactagacgcaggcagagatgtctgttcctttttggctggtgtgcaggtggtgcatggctgtcgtcagctcgtgtcgtgagatgttgggttaagtcccgcaacgagcgcaaccctcgtcctatgttgccagcacgtaatggtggggactcataggagactgccggggtcaactcggaggaaggtggggatgacgtcaagtcttcatgccccttatgtccagggcttcacgcatgctacaatggccggtacagaccgctgcgatcccgcgagggtgagcgaatcggaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcctaacccgtaagggggggagccgtcgaaggtggggctggtgattgggacgaagtcgtaacaaggtagccgtaccggaaggtgcggctggatcacctcctttctaaggagca

SEQ ID NO: 6048 - DNA, 1527 bp, Nocardioides ganghwensis
  ref <308>: DATABASE ACCESSION NUMBER: NCBI ACCESSION: NZ_SDWU01000040.1
  ref <309>: DATABASE ENTRY DATE: 2019-04-01
  ref <313>: RELEVANT RESIDUES IN SEQ ID NO: (1)..(1527)
ttcgatggagagtttgatcctggctcaggacgaacgctggcggcgtgcttaacacatgcaagtcgagcggaaaggccacttcggtggtactcgagcggcgaacgggtgagtaacacgtgagtaatctgcccttggctttgggatagccaccggaaacggtgattaataccgaatatgaccacttcacgcatgtgatggtggtggaaagtttttcggccagggatgtgctcgcggcctatcagcttgatggtgaggtaatggctcaccatggcttcgacgggtagccggcctgagagggtgaccggtcacactgggactgagacacggcccagactcctacgggaggcagcagtggggaatattggacaatgggcggaagcctgatccagcaacgccgcgtgagggatgactgccttcgggttgtaaacctctttcggtggggacgaagcgcaagtgacggtacccactaaagaagcaccggccaactacgtgccagcagccgcggtaatacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccctgccgctccagagatggggcttcttttgggggtgtacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcatcatgccccttatgtccagggcttcacgcatgctacaatggccggtacaaagggctgcgatcccgtaagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 6049 - DNA, 1534 bp, Nocardioides glacieisoli
  ref <308>: DATABASE ACCESSION NUMBER: NCBI ACCESSION: NZ_SDWS01000022.1
  ref <309>: DATABASE ENTRY DATE: 2019-04-01
  ref <313>: RELEVANT RESIDUES IN SEQ ID NO: (1)..(1534)
ttcgatggagagtttgatcctggctcaggacgaacgctggcggcgtgcttaacacatgcaagtcgagcggaaaggccacttcggtggtactcgagcggcgaacgggtgagtaacacgtgagtaatctgcccttggctttgggatagccaccggaaacggtgattaataccgaatacgacaactactcgcatgggttggttgtggaaagtttttcggccagggatgtgctcgcggcctatcagcttgatggtgaggtaatggctcaccatggcttcgacgggtagccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcggtagggacgaagcgcaagtgacggtacctgctaaagaagcaccggccaactacgtgccagcagccgcggtaatacgtagggtgcgagcgttgtccggaattattgggcgtaaagggctcgtaggcggtttgtcgcgtcgggagtgaaaaccaggtgcttaacacctggcttgctttcgatacgggcagactagaggtatgcaggggagaacggaattcctggtgtagcggtgaaatgcgcagatatcaggaggaacaccggtggcgaaggcggttctctgggcatgacctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccctgccgctccagagatggggcttcttttgggggtgtacaggtggtgcatggctgtcgtcagctcgtgtcgtgagatgttgggttaagtcccgcaacgagcgcaaccctcgttctatgttgccagcatgcccttcggggtgatggggactcataggagactgccggggtcaactcggaggaaggtggggatgacgtcaagtcatcatgccccttatgtccagggcttcacgcatgctacaatggccggtacaaagggctgcgatcccgtaagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 6050 - DNA, 1286 bp, Nocardioides immobilis
  ref <308>: DATABASE ACCESSION NUMBER: NCBI ACCESSION: NZ_QXGH01000063.1
  ref <309>: DATABASE ENTRY DATE: 2019-04-01
  ref <313>: RELEVANT RESIDUES IN SEQ ID NO: (1)..(1286)
tcttatggagagtttgatcctggctcaggacgaacgctggcggcgtgcttaacacatgcaagtcgagcggtaaggccctttcgggggtacacgagcggcgaacgggtgagtaacacgtgagtaatctgcccttggctctgggataagcattcgaaagggtgtctaataccggatatgatgactccccgcatggggtggttgtggaaagttttttcggccagggatgtgctcgcggcctatcagcttgttggtgaggtaatggctcaccaaggctttgacgggtaaccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcaccattgacgaagccttcgggtgacggtaggtggagaagaagcaccggccaactacgtgccagcagccgcggtaatacgtagggtgcgagcgttgtccggaattattgggcgtaaagggctcgtaggcggtttgttgcgtcgggagtgaaaacatcgggcttaactcgatgcttgctttcgatacgggcagacttgaggtatgcaggggagaatggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggacctattccatgggttccgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccggaagcctctagagatagaggtctctttgatactggtgtacaggtggtgcatggctgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaagtcatcatgcccctctgtccagggcttcacgcatgctacaatggccggtacaaagggctgcgatcccgtgagggggagcgaatcccaaaaagccggtctcagttcggatc

SEQ ID NO: 6051 - DNA, 1528 bp, Nocardioides iriomotensis
  ref <308>: DATABASE ACCESSION NUMBER: NCBI ACCESSION: NZ_SDPU01000020.1
  ref <309>: DATABASE ENTRY DATE: 2019-04-01
  ref <313>: RELEVANT RESIDUES IN SEQ ID NO: (1)..(1528)
ttcaacggagagtttgatcctggctcaggacgaacgctggcggcgtgcttaacacatgcaagtcgagcggtaaggctccttcgggagtacacgagcggcgaacgggtgagtaacacgtgagcaatctgcccttcacacagggataactccgggaaaccgaagctaatacctgatacgaccacttcaggcatctgatggtggtggaaagttccggcggtgaaggatgagctcgcggcctatcagcttgttggtggggtaacggcccaccaaggcaacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgcaagtgacggtacctgcagaagaagcaccggccaactacgtgccagcagccgcggtaatacgtagggtgcgagcgttgtccggaattattgggcgtaaagggctcgtaggcggtctgtcgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatagagaaatcccctagagatagggggtccgtaagggctctatacaggtggtgcatggctgtcgtcagctcgtgtcgtgagatgttgggttaagtcccgcaacgagcgcaaccctcgtcttatgttgccagcacgtaatggtggggactcataagagactgccggggtcaactcggaggaaggtggggatgacgtcaagtcatcatgccccttatgtccagggcttcacgcatgctacaatggccggtacaaagggctgcgaaaccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagtcgtcgaaggtggggctggcgattgggacgaagtcgtaacaaggtagccgtaccggaaggtgcggctggatcacctcctttctaaggag

SEQ ID NO: 6052 - DNA, 1526 bp, Nocardioides oleivorans
  ref <308>: DATABASE ACCESSION NUMBER: NCBI ACCESSION: NZ_SDWT01000008.1
  ref <309>: DATABASE ENTRY DATE: 2019-04-01
  ref <313>: RELEVANT RESIDUES IN SEQ ID NO: (1)..(1526)
ttcgatggagagtttgatcctggctcaggacgaacgctggcggcgtgcttaacacatgcaagtcgagcggaaaggccacttcggtggtactcgagcggcgaacgggtgagtaacacgtgagtaatctgcccctggctttgggatagccaccggaaacggtgattaataccggatatgaccattcttcgcatgaggtgtggtggaaagtttttcggccagggatgtgctcgcggcctatcagcttgatggtgaggtaatggctcaccatggcttcgacgggtagccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcggtggggacgaagcgcaagtgacggtacccactaaagaagcaccggccaactacgtgccagcagccgcggtaatacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccctgccgctccagagatggggcttcttttgggggtgtacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcatcatgccccttatgtccagggcttcacgcatgctacaatggccggtacaaagggctgcgatcccgtgagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 6053 - DNA, 1528 bp, Nocardioides sp. 603
  ref <308>: DATABASE ACCESSION NUMBER: NCBI ACCESSION: NZ_CP033324.1
  ref <309>: DATABASE ENTRY DATE: 2019-04-01
  ref <313>: RELEVANT RESIDUES IN SEQ ID NO: (1)..(1528)
ttcaacggagagtttgatcctggctcaggacgaacgctggcggcgtgcttaacacatgcaagtcgagcggtaaggccctttcgggggtacacgagcggcgaacgggtgagtaacacgtgagtaatctgcccttcacttcgggataagcctcggaaacggggtctaataccggatacgacgcagtcctgcatgggatctgcgtggaaagtttttcggtgaaggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcgccgacgaagcgaaagtgacggtaggcgcagaagaagcaccggccaactacgtgccagcagccgcggtaatacgtagggtgcgagcgttgtccggaattattgggcgtaaagggctcgtaggcggtttgtcgcgtcgggagtgaaaacccagggcttaaccctgggctggctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacgccggaaacccctagagataggggcccttttagtcggtgtacaggtggtgcatggctgtcgtcagctcgtgtcgtgagatgttgggttaagtcccgcaacgagcgcaaccctcgtcctatgttgccagcgggtaatgccggggactcataggagactgccggggtcaactcggaggaaggtggggatgacgtcaagtcatcatgccccttatgtccagggcttcacgcatgctacaatggccggtacaaagggctgcgatcccgtgagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcctaaccccttgtgggagggagccgtcgaaggtggggctggcgattgggacgaagtcgtaacaaggtagccgtaccggaaggtgcggctggatcacctcctttctaaggag

SEQ ID NO: 6054 - DNA, 1524 bp, Nocardioides sp. CF479
  ref <308>: DATABASE ACCESSION NUMBER: NCBI ACCESSION: NZ_RBLE01000007.1
  ref <309>: DATABASE ENTRY DATE: 2019-04-01
  ref <313>: RELEVANT RESIDUES IN SEQ ID NO: (1)..(1524)
ttcgatggagagtttgatcctggctcaggacgaacgctggcggcgtgcttaacacatgcaagtcgagcggaaaggcccttcggggtactcgagcggcgaacgggtgagtaacacgtgagtaatctgcccctggctttgggatagccaccggaaacggtgattaataccggatatgaccactttacgcatgtttggtggtggaaagtttttcggccagggatgtgctcgcggcctatcagcttgatggtgaggtaatggctcaccatggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagtaccgacgaagcgcaagtgacggtaggtacagaagaagcaccggccaactacgtgccagcagccgcggtaatacgtagggtgcgagcgttgtccggaattattgggcgtaaagggctcgtaggcggtttgtcgcgtcgggagtgaaaaccaggtgcttaacacctggcttgctttcgatacgggcagactagaggtattcaggggagaacggaattcctggtgtagcggtgaaatgcgcagatatcaggaggaacaccggtggcgaaggcggttctctgggaatatcctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccctgccgctccagagatggggcttcttttgggggtgtacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcatcatgccccttatgtccagggcttcacgcatgctacaatggccggtacaaagggctgcgatcccgtgagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 6055 - DNA, 1534 bp, Nocardioides sp. HLT2-9
  ref <308>: DATABASE ACCESSION NUMBER: NCBI ACCESSION: NZ_SDWV01000039.1
  ref <309>: DATABASE ENTRY DATE: 2019-04-01
  ref <313>: RELEVANT RESIDUES IN SEQ ID NO: (1)..(1534)
ttcgatggagagtttgatcctggctcaggacgaacgctggcggcgtgcttaacacatgcaagtcgagcggaaaggccacttcggtggtactcgagcggcgaacgggtgagtaacacgtgagtaatctgcccctggctttgggatagccaccggaaacggtgattaataccggatacgaccgctcctcgcatgaggtggtggtggaaagtttttcggccagggatgtgctcgcggcctatcagcttgatggtgaggtaatggctcaccatggcttcgacgggtagccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcggtggggacgaagcgcaagtgacggtacccactaaagaagcaccggccaactacgtgccagcagccgcggtaatacgtagggtgcgagcgttgtccggaattattgggcgtaaagggctcgtaggcggtttgtcgcgtcgggagtgaaaaccaggtgcttaacacctggcttgctttcgatacgggcagactagaggtatgcaggggagaacggaattcctggtgtagcggtgaaatgcgcagatatcaggaggaacaccggtggcgaaggcggttctctgggcatgacctgacgctgaggagcgaaagtgtggggagcgaacaggattagataccctggtagtccacaccgtaaacgttgggcgctaggtgtggggtccattccacggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccctgccgctccagagatggggcttcttttgggggtgtacaggtggtgcatggctgtcgtcagctcgtgtcgtgagatgttgggttaagtcccgcaacgagcgcaaccctcgttctatgttgccagcatgcccttcggggtgatggggactcataggagactgccggggtcaactcggaggaaggtggggatgacgtcaagtcatcatgccccttatgtccagggcttcacgcatgctacaatggccggtacaaagggctgcgatcccgtaagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 6056 - DNA, 1526 bp, Nocardioides sp. HY056
  ref <308>: DATABASE ACCESSION NUMBER: NCBI ACCESSION: NZ_CP034929.1
  ref <309>: DATABASE ENTRY DATE: 2019-04-01
  ref <313>: RELEVANT RESIDUES IN SEQ ID NO: (1)..(1526)
ttcaatggagagtttgatcctggctcaggacgaacgctggcggcgtgcttaacacatgcaagtcgagcggtaaggcccttcggggtacacgagcggcgaacgggtgagtaacacgtgagtaatctgcccttcacttcgggataagcaccggaaacggtgtctaataccgaatatgaactgcctctgcatggaggtggttggaaagttccggcggtgaaggatgtgctcgcggcctatcagcttgttggtgaggtaatggctcaccaaggcttcgacgggtagccggcctgagagggtgatcggccacactgggactgagacacggcccagactcctacgggaggcagcagtggggaatattggacaatgggcgaaagcctgatccagcaacgccgcgtgagggatgactgccttcgggttgtaaacctctttcagtagggacgaagcgaaagtgacggtacctacagaagaagcaccggccaactacgtgccagcagccgcggtaatacgtagggtgcgagcgttgtccggaattattgggcgtaaagggctcgtaggcggtttgtcacgtcgggagtgaaaaccaggtgcttaacacctggcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtggggtctattccatggattccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatgccggaaacacctagagataggtgcccctttttggtcggtatacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcatcatgccccttatgtccagggcttcacgcatgctacaatggccggtacaaagggctgcgatcccgtgagggggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggag

SEQ ID NO: 6057 - DNA, 1526 bp, Nocardioides sp. HY057; identical to SEQ ID NO: 6056
  ref <308>: DATABASE ACCESSION NUMBER: NCBI ACCESSION: NZ_SAYL01000011.1
  ref <309>: DATABASE ENTRY DATE: 2019-04-01
  ref <313>: RELEVANT RESIDUES IN SEQ ID NO: (1)..(1526)

SEQ ID NO: 6058 - DNA, 1527 bp, Nocardioides sp. K1W22B-1
  ref <308>: DATABASE ACCESSION NUMBER: NCBI ACCESSION: NZ_QYRP01000002.1
  ref <309>: DATABASE ENTRY DATE: 2019-04-01
  ref <313>: RELEVANT RESIDUES IN SEQ ID NO: (1)..(1527)
ttcaacggagagtttgatcctggctcaggacgaacgctggcggcgtgcttaacacatgcaagtcgagcggtaaggcctttcggggtacacgagcggcgaacgggtgagtaacacgtgagcaatctgcccttcactctgggatagccaccggaaacggtgattaataccggatatgaccactacccgcatgggttggtggtggaaagttctggcggtggaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgaatgccttcgggttgtaaacctctttcagcggggacgaagcgaaagtgacggtacccgcagaagaagcaccggccaactacgtgccagcagccgcggtaatacgtagggtgcaagcgttgtccggaattattgggcgtaaagggctcgtaggcggtttgtcacgtcgggagtgaaaactcggggcttaaccccgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggacacattccacgtgttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatgccggaaagcatcagagatggtgcccccttttggtcggtatacaggtggtgcatggctgtcgtcagctcgtgtcgtgagatgttgggttaagtcccgcaacgagcgcaaccctcgtcttatgttgccagcacgtaatggtggggactcataagagactgccggggtcaactcggaggaaggtggggatgacgtcaagtcatcatgccccttatgtccagggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggtaacacccgaagccggtggcctaacccgtaagggagggagctgtcgaaggtgggacgagcgattgggacgaagtcgtaacaaggtagccgtaccggaaggtgcggctggatcacctcctttctaaggag

SEQ ID NO: 6059 - DNA, 1107 bp, Nocardioides sp. LS1
  ref <308>: DATABASE ACCESSION NUMBER: NCBI ACCESSION: NZ_BIFF01000001.1
  ref <309>: DATABASE ENTRY DATE: 2019-04-01
  ref <313>: RELEVANT RESIDUES IN SEQ ID NO: (1)..(1107)
ttcaacggagagtttgatcctggctcaggacgaacgctggcggcgtgcttaacacatgcaagtcgagcggaaaggccacttcggtggtactcgagcggcgaacgggtgagtaacacgtgagtaatctgcccttcacttcgggatagccctgggaaactaggattaataccggatatgacgaccgtctgcatggactggttgtggaaagttttttcggtggaggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagtagggacgaagcgcaagtgacggtacctacagaagaagcaccggccaactacgtgccagcagccgcggtaatacgtagggtgcgagcgttgtccggaattattgggcgtaaagggctcgtaggcggtttgtcgcgtcgggagtgaaaaccatgggcttaactcatggcttgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtggggcctattccatgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatgccggaaagctctagagatagagccccttttagtcggtatacaggtggtgcatggctgtcgtcagctcgtgtcgtgagatgttgggttaagtcccgcaacgagcgcaaccctcgtcctatgttgccagca

SEQ ID NO: 6060 - DNA, 1541 bp, Nocardioides sp. PD653
  ref <308>: DATABASE ACCESSION NUMBER: NCBI ACCESSION: NZ_BDJG01000021.1
  ref <309>: DATABASE ENTRY DATE: 2019-04-01
  ref <313>: RELEVANT RESIDUES IN SEQ ID NO: (1)..(1541)
ttcaacggagagtttgatcctggctcaggacgaacgctggcggcgtgcttaacacatgcaagtcgagcggtaaggccctttcgggggtacacgagcggcgaacgggtgagtaacacgtgagtaatctgcccttcacttggggataagcaccggaaacggtgtctaatacccgatacgaccaacccctgcatggggtgttggtggaaagttttttcggtgggggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcggggacgaagcgccgatgatggtggtgacggtacccgcagaagaagcaccggccaactacgtgccagcagccgcggtaatacgtagggtgcgagcgttgtccggaattattgggcgtaaagggctcgtaggcggtttgtcgcgtcgggagtgaaaacaccgggcttaactcggtgcttgctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtggggcctattccatgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatgccggaaagccccagagatggggccccttttagtcggtatacaggtggtgcatggctgtcgtcagctcgtgtcgtgagatgttgggttaagtcccgcaacgagcgcaaccctcgtcctatgttgccagcatgccttcgggtgatggggactcataggagactgccggggtcaactcggaggaaggtggggatgacgtcaagtcatcatgccccttatgtccagggcttcacgcatgctacaatggccggtacaaagggctgcgatgctgtaaggcggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcctaacccttgtggagggagccgtcgaaggtggggctggcgattgggacgaagtcgtaacaaggtagccgtaccggaaggtgcggctggatcacctcctttctaaggag

SEQ ID NO: 6061 - DNA, 1541 bp, Nocardioides sp. PD653-B2; identical to SEQ ID NO: 6060
  ref <308>: DATABASE ACCESSION NUMBER: NCBI ACCESSION: NZ_BDJE01000061.1
  ref <309>: DATABASE ENTRY DATE: 2019-04-01
  ref <313>: RELEVANT RESIDUES IN SEQ ID NO: (1)..(1541)

SEQ ID NO: 6062 - DNA, 1528 bp, Nocardioides sp. SZ4R5S7
  ref <308>: DATABASE ACCESSION NUMBER: NCBI ACCESSION: NZ_QZVR01000028.1
  ref <309>: DATABASE ENTRY DATE: 2019-04-01
  ref <313>: RELEVANT RESIDUES IN SEQ ID NO: (1)..(1528)
ttcaacggagagtttgatcctggctcaggacgaacgctggcggcgtgcttaacacatgcaagtcgagcggaaaggccctttcgggggtactcgagcggcgaacgggtgagtaacacgtgagtaatctgcccttcacttcgggataactaccggaaacggtggctaataccggatatgagcatcgcaggcatctgtggtgttggaaagttttttcggtggaggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcgccgacgaagcgagagtgacggtaggcgcagaagaagcaccggccaactacgtgccagcagccgcggtaatacgtagggtgcgagcgttgtccggaattattgggcgtaaagggctcgtaggcggtttgtcgcgtcgggagtgaaaacaccgggcttaactcggtgcttgctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggatccattccacgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacgccggaaagcgccagagatggtgcccctttttgtcggtgtacaggtggtgcatggctgtcgtcagctcgtgtcgtgagatgttgggttaagtcccgcaacgagcgcaaccctcgtcctatgttgccagcacgttatggtggggactcataggagactgccggggtcaactcggaggaaggtggggatgacgtcaagtcatcatgccccttatgtccagggcttcacgcatgctacaatggccggtacaaagggctgcgatgctgtaaggcggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcctaaccccttgtgggagggagccgtcgaaggtggggctggcgattgggacgaagtcgtaacaaggtagccgtaccggaaggtgcggctggatcacctcctttctaaggag

SEQ ID NO: 6063 - DNA, 1526 bp, Nocardioides sp. WSJ-1
  ref <308>: DATABASE ACCESSION NUMBER: NCBI ACCESSION: NZ_QDGZ01000021.1
  ref <309>: DATABASE ENTRY DATE: 2019-04-01
  ref <313>: RELEVANT RESIDUES IN SEQ ID NO: (1)..(1526)
ttcgatggagagtttgatcctggctcaggacgaacgctggcggcgtgcttaacacatgcaagtcgagcggaaaggccctttcgggggtactcgagcggcgaacgggtgagtaacacgtgagtaatctgccctgcgcttcgggatagcttcgggaaaccgaaattaataccggatatgactcgtccctgcatgggggtgggtggaaagctttatgtggcgcaggatgtgctcgcggcctatcagcttgatggtggggtaatggcctaccatggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagtaccgacgaagcggaagtgacggtaggtacagaagaagcaccggccaactacgtgccagcagccgcggtaatacgtagggtgcgagcgttgtccggaattattgggcgtaaagggctcgtaggcggtttgtcgcgtcgggagtgaaaacaccgggcttaactcggtgcttgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggatccattccacgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccggaaagctccagagatggagccccttttgctggtgtacaggtggtgcatggctgtcgtcagctcgtgtcgtgagatgttgggttaagtcccgcaacgagcgcaaccctcgtcctatgttgccagcgggtcatgccggggactcataggagactgccggggtcaactcggaggaaggtggggatgacgtcaagtcatcatgccccttatgtccagggcttcacgcatgctacaatggccggtacaaagggctgcgatgctgtaaggcggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggag

SEQ ID NO: 6064 - DNA, 1528 bp, Nocardioides sp. X2025; identical to SEQ ID NO: 6053
  ref <308>: DATABASE ACCESSION NUMBER: NCBI ACCESSION: NZ_RHDV01000011.1
  ref <309>: DATABASE ENTRY DATE: 2019-04-01
  ref <313>: RELEVANT RESIDUES IN SEQ ID NO: (1)..(1528)

SEQ ID NO: 6065 - DNA, 1523 bp, Nocardioides sp. YR527
  ref <308>: DATABASE ACCESSION NUMBER: NCBI ACCESSION: NZ_FNFN01000019.1
  ref <309>: DATABASE ENTRY DATE: 2019-04-01
  ref <313>: RELEVANT RESIDUES IN SEQ ID NO: (1)..(1523)
ttcaacggagagtttgatcctggctcaggacgaacgctggcggcgtgcttaacacatgcaagtcgagcggaaaggcccttcggggtactcgagcggcgaacgggtgagtaacacgtgagtaatctgccccaggctctgggatagccaccggaaacggtgattaataccggatacgacaaccgattgcatgatctggttgtggaaagtttttcggcctgggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattattgggcgtaaagggctcgtaggcggtctgtcgcgtcgggagtgaaaaccaggtgcttaacacctggcctgctttcgatacgggcagactagaggtactcaggggagaatggaattcctggtgtagcggtgaaatgcgcagatatcaggaggaacaccggtggcgaaggcggttctctgggagtatcctgacgctgaggagcgaaagtgtggggagcgaacaggattagataccctggtagtccacaccgtaaacgttgggcgctaggtgtgggatccattccacgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacaccggaaagctgcagagatgtagccccttttagtcggtgtacaggtggtgcatggctgtcgtcagctcgtgtcgtgagatgttgggttaagtcccgcaacgagcgcaaccctcgtcctatgttgccagcaattcggttggggactcataggagactgccggggtcaactcggaggaaggtggggatgacgtcaagtcatcatgccccttatgtccagggcttcacgcatgctacaatggccggtacaaagggctgcgatcccgtgagggtgagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccagtggcccaacccttgtggggggagctgtcgaaggtggggctggcgattgggacgaagtcgtaacaaggtagccgtaccggaaggtgcggctggatcacctcctttctaaggag

SEQ ID NO: 6066 - DNA, 1545 bp, Nocardioides szechwanensis
  ref <308>: DATABASE ACCESSION NUMBER: NCBI ACCESSION: NZ_FNIC01000016.1
  ref <309>: DATABASE ENTRY DATE: 2019-04-01
  ref <313>: RELEVANT RESIDUES IN SEQ ID NO: (1)..(1545)
ttctacggagagtttgatcctggctcaggacgaacgctggcggcgtgcttaacacatgcaagtcgagcggtaaggccctttcgggggtacacgagcggcgaacgggtgagtaacacgtgagtaatctgccctccacttggggataagcttcggaaacggggtctaatacctgatacgacactctcctgcatgggatgggtgtggaaagttttttcggtgggggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcagtaccgacgaagcgcccgttgtgggtggtgacggtaggtacagaagaagcaccggccaactacgtgccagcagccgcggtaatacgtagggtgcgagcgttgtccggaattattgggcgtaaagggctcgtaggcggtttgtcgcgtcgggagtgaaaacaccgggcttaactcggtgcttgctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtggggcctattccatgggttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatatagagaaaactgctagagatagcaggtccgtaagggttctatacaggtggtgcatggctgtcgtcagctcgtgtcgtgagatgttgggttaagtcccgcaacgagcgcaaccctcgttctatgttgccagcaagcccttcggggtgttggggactcataggagactgccggggtcaactcggaggaaggtggggatgacgtcaagtcatcatgccccttatgtccagggcttcacgcatgctacaatggccggtacaaagggctgcgatgctgtaaggcggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggag

SEQ ID NO: 6067 - DNA, 1552 bp, Nocardiopsaceae bacterium YIM 96095
  ref <308>: DATABASE ACCESSION NUMBER: NCBI ACCESSION: NZ_RJMB01000020.1
  ref <309>: DATABASE ENTRY DATE: 2019-04-01
  ref <313>: RELEVANT RESIDUES IN SEQ ID NO: (1)..(1552)
ttacggagagtttgatcctggctcaggacgaacgctggcggcgtgcttaacacatgcaagtcgagcgaggcgctctcttcggagagccgtcgagcggcgaacggctgagtaacacgtgagcaacctaccctcggctccgggataacctcgggaaactgaggctaataccggatacgaccacgcgcggcatcgcgcgtggtggaaaggttgtcgtccgtgagggcggcttccggccgtggatgggctcgcggcctatcagcttgttggtgcggtaagagcgcaccaaggcgatgacgggtagccgacctgagagggtgaccggccagactgggactgagacacggcccagactcctgcgggaggcagcagtggggaatcttgcgcaatgggcgaaagcctgacgcagcgacgccgcgtgggggatgacggccttagggtcgtaaacctcttttcctcccgacgaaggccccacgtactcgtggggttgacggtacggagggaataaggaccggctgactacgtgccagcagccgcggtaatacgtagggtccaagcgttgtccggaattactgggcgtaaagagctcgtaggcggcccgtcacgtcggtcgtgcaagtcctgggctcaactcaggaattgcgatcgatacgggcgggctagagggcggaagaggcgagcggaattcccggtgtagcggtgaaatgcgcagatatcgggaggaacaccggtggcgaaggcggctcgctgggccgttcctgacgctgaggagcgaaagcgtgggtagcgaacaggattagataccctggtagtccacgccgtaaacgttgggcgctaggtgtggggctcttaatcgagttccgtgccgcagctaacgcgttaagcgccccgcctggggagtacggccgcaaggctaaaactcaaaggaattgacgggggcccgcacaagcggcggagtatgtggcttaattcgatgcaacgcgaagaaccttaccggggcttgacatgccgggaaatcctccagagatggggggtgcctttgggcgtccggcacaggtggtgcatggctgtcgtcagctcgtgtcgtgagatgttgggttaagtcccacaacgagcgcaacccttgtcccgtgttaccagcaccgcgggtggggactcacgggagaccgccggggacaacccggaggaaggcggggatgacgtcaagtcatcatgccccttatgtcccgggccgcacacgtactacaatggccggtacaacgggccgcgatctcgcaagggtgagcgaatccctgaaaaccggtctcagttcggatcggggtctgcaattcgaccccgtgaaggtggagtcgctagtaatcgcggatcagcatgccgcggtgaatacgttcccgggccttgtacacaccgcccgtcacgtacggggagttggcaatgcccgaagtcggtggcccaacccttacgggagggagccgacgaaggcagggctggcgaccggtacgaagtcgtaacaaggtagccgtaccggaaggtgcggctggatcacctcctttct

SEQ ID NO: 6068 - DNA, 1541 bp, Nocardiopsis dassonvillei
  ref <308>: DATABASE ACCESSION NUMBER: NCBI ACCESSION: NZ_LR134501.1
  ref <309>: DATABASE ENTRY DATE: 2019-04-01
  ref <313>: RELEVANT RESIDUES IN SEQ ID NO: (1)..(1541)
tttatggagagtttgatcctggctcaggacgaacgctggcggcgtgcttaacacatgcaagtcgagcggtaaggcccttcggggtacacgagcggcgaacgggtgagtaacacgtgagcaacctgcccctgactctgggataagcggtggaaacgccgtctaataccggatacgacccgccacctcatggtggagggtggaaagtttttcggtcagggatgggctcgcggcctatcagcttgttggtggggtaacggcctaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttaccaccaacgcaggcttccagttctctggaggttgacggtaggtggggaataaggaccggctaactacgtgccagcagccgcggtaatacgtagggtccgagcgttgtccggaattattgggcgtaaagagctcgtaggcggcgtgtcgcgtctgctgtgaaagaccggggcttaactccggttctgcagtggatacgggcatgctagaggtaggtaggggagactggaattcctggtgtagcggtgaaatgcgcagatatcaggaggaacaccggtggcgaaggcgggtctctgggccttacctgacgctgaggagcgaaagcatggggagcgaacaggattagataccctggtagtccatgccgtaaacgttgggcgctaggtgtggggactttccacggtttccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcacccgtggactcgcagagatgtgaggtcatttagttggcgggtgacaggtggtgcatggctgtcgtcagctcgtgtcgtgagatgttgggttaagtcccgcaacgagcgcaacccttgttccatgttgccagcacgtaatggtggggactcatgggagactgccggggtcaactcggaggaaggtggggatgacgtcaagtcatcatgccccttatgtcttgggctgcaaacatgctacaatggccggtacaatgggcgtgcgataccgtaaggtggagcgaatccctaaaagccggtctcagttcggattggggtctgcaactcgaccccatgaaggtggagtcgctagtaatcgcggatcagcaacgccgcggtgaatacgttcccgggccttgtacacaccgcccgtcacgtcatgaaagtcggcaacacccgaaacttgcggcctaaccccttgtgggagggagtgagtgaaggtggggctggcgattgggacgaagtcgtaacaaggtagccgtaccggaaggtgcggctggatcacctcctttctaaggag

SEQ ID NO: 6069 - DNA, 1536 bp, Nocardiopsis sp. FIRDI 009
  ref <308>: DATABASE ACCESSION NUMBER: NCBI ACCESSION: NZ_QPNC01000030.1
  ref <309>: DATABASE ENTRY DATE: 2019-04-01
  ref <313>: RELEVANT RESIDUES IN SEQ ID NO: (1)..(1536)
tttatggagagtttgatcctggctcaggacgaacgctggcggcgtgcttaacacatgcaagtcgagcggtaaggcccttcggggtacacgagcggcgaacgggtgagtaacacgtgagcaacctgcccctgactccgggataagcggtggaaacgccgtctaataccggatacgaccctccgcctcatggtggggggtggaaagttgtgtcggtcagggatgggctcgcggcctatcagcttgttggtggggtaacggcctaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttaccaccaacgcaggctccgggtgttctcggggttgacggtaggtggggaataaggaccggctaactacgtgccagcagccgcggtaatacgtagggtccgagcgttgtccggaattattgggcgtaaagagctcgtaggcggcgtgtcgcgtctgctgtgaaagaccggggcttaactccggttctgcagtggatacgggcatgctagaggtaggtaggggagactggaattcctggtgtagcggtgaaatgcgcagatatcaggaggaacaccggtggcgaaggcgggtctctgggccttacctgacgctgaggagcgaaagcatggggagcgaacaggattagataccctggtagtccatgccgtaaacgttgggcgctaggtgtggggactttccacggtttccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcacccgtggacctgcagagatgtggggtcatttagttggtgggtgacaggtggtgcatggctgtcgtcagctcgtgtcgtgagatgttgggttaagtcccgcaacgagcgcaacccttgttccatgttgccagcacgtagtggtggggactcatgggagactgccggggtcaactcggaggaaggtggggacgacgtcaagtcatcatgccccttatgtcttgggctgcaaacatgctacaatggccggtacaatgggcgtgcgataccgtgaggtggagcgaatccctaaaagccggtctcagttcggattggggtctgcaactcgaccccatgaaggtggagtcgctagtaatcgcggatcagcaacgccgcggtgaatacgttcccgggccttgtacacaccgcccgtcacgtcatgaaagtcggcaacacccgaaacttgtggcccaacccttcggggagggagtgagtgaaggtggggctggcgattgggacgaagtcgtaacaaggtagccgtaccggaaggtgcggctggatcacctcctttcta

SEQ ID NO: 6070 - DNA, 1541 bp, Nocardiopsis sp. Huas11
  ref <308>: DATABASE ACCESSION NUMBER: NCBI ACCESSION: NZ_RBKY01000001.1
  ref <309>: DATABASE ENTRY DATE: 2019-04-01
  ref <313>: RELEVANT RESIDUES IN SEQ ID NO: (1)..(1541)
tttatggagagtttgatcctggctcaggacgaacgctggcggcgtgcttaacacatgcaagtcgagcggtaaggcccttcggggtacacgagcggcgaacgggtgagtaacacgtgagcaacctgcccctgactctgggataagcggtggaaacgccgtctaataccggatacgaccggccacctcatggtggacggtggaaagttttatcggtcagggatgggctcgcggcctatcagctagttgtggggtaaaggcctaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttaccaccaacgcaggctccacgttctcgtgggggttgacggtaggtggggaataaggaccggctaactacgtgccagcagccgcggtaatacgtagggtccgagcgttgtccggaattattgggcgtaaagagctcgtaggcggcgtgtcgcgtctgctgtgaaagaccggggcttaactccggttctgcagtggattacgggcatgctagaggtaggtagggagactggaattcctggtgtagcggtgaaatgcgcagatatcaggaggaacaccggtggcgaaggcgggtctctgggccttacctgacgctgaggagcgaaagcatggggagcaacaggattaagatacccgtggtagtccatgccgtaaacgttgggcgctaggtgtggggactttccacggtttccgcgccgtagctaacgcattaagcgcccccgcctggggagtacggccgcaaggctaaaacttcaaaggaattgacgggggcccgcacaagcggcggagcatgttgcttaattcgacgcaacgcgaagaaccttaccaaggttttgacatcacccgtggacctgcagagatgtggggtcatttagttggtgggtgacaggtggtgcatggctgtcgtcagctcgtgtcgtgagatgttgggttaagtcccgcaacgagcgcaacccttattccatgttgccagcacgtaatggtggggactcatgggagactgccggggtcaactcggaggaaggtggggacgacgtcaagtcatcatgccccttatgtcttgggctgcaaacatgctacaatggccggtacaatgggcgtgcgataccgtaaggtggagcgaatccctaaaagccggtctcagttcggattggggtctgcactcgaccccatgaaggtggagtcgctagtaatcgcggatcagcaacgcgcggtgaatacgttcccgggccttgtacacaccgcccgtcacgtcatgaaagtcggcaaacacccgaaacttgtggctaacccttcggggagggaatgagtgaaggtggggctggcgattgggacgaaagtcgtaaacaaggtagccgtaccggaaggtgcggctggatcacctcctttctaa

SEQ ID NO: 6071 - DNA, 1541 bp, Nocardiopsis sp. TNDT3; identical to SEQ ID NO: 6068
  ref <308>: DATABASE ACCESSION NUMBER: NCBI ACCESSION: NZ_QPFC01001127.1
  ref <309>: DATABASE ENTRY DATE: 2019-04-01
  ref <313>: RELEVANT RESIDUES IN SEQ ID NO: (1)..(1541)

SEQ ID NO: 6072 - DNA, 1489 bp, Nodosilinea nodulosa
  ref <308>: DATABASE ACCESSION NUMBER: NCBI ACCESSION: NZ_JH976537.1
  ref <309>: DATABASE ENTRY DATE: 2019-04-01
  ref <313>: RELEVANT RESIDUES IN SEQ ID NO: (1)..(1489)
aacatggagagtttgatcctggctcaggatgaacgctggcggcgtgcttaacacatgcaagtcgaacggacccttcggggttagtggcggacgggtgagtaacgcgtgaggatctgcccttaggaggggaacaacagttggaaacgactgctaatgccccatatgccgagaggtgaaatgtaattcgcctgaggatgaactcgcgtctgattagctagttggtgaggtaagggctcaccaaggcgacgatcagtagctggtctaagaggatgatcagccacactgggactgagacacggcccagactcctacgggaggcagcagtggggaattttccgcaatgggcgaaagcctgacggagcaacgccgcgtgagggaggaaggccttagggttgtaaacctcttttctctgggaagaagatctgacggtaccagaggaataagcctcggctaactccgtgccagcagccgcggtaagacggaggaggcaagcgttatccggaattattgggcgtaaagcgtccgcaggcggttttttaagtctgttgtcaaagcccacagctcaactgtggatcggcaatggaaactgggagactagagtgtggtaggggtagagggaattcccggtgtagcggtgaaatgcgtagatatcgggaagaacaccagtggcgaaggcgctctactgggccacaactgacgctgagggacgaaagctaggggagcgaaagggattagatacccctgtagtcctagctgtaaacgatggatactaggtgttggacgtatcgacccgtgcagtaccgtagctaacgcgttaagtatcccgcctggggagtacgcacgcaagtgtgaaactcaaaggaattgacgggggcccgcacaagcggtggaggatgtggtttaattcgatgcaacgcgaagaaccttaccaaggcttgacatgtcgcgaatctttcagagatgagagagtgccttcgggagcgcgaacacaggtggtgcatggctgtcgtcagctcgtgtcgtgagatgttgggttaagtcccgcaacgagcgcaaccctcgtttttagttgccatcattaagttgggcactctaaagagactgccggggacaactcggaggaaggtggggacgacgtcaagtcatcatgccccttacgtcttgggctacacacgtcctacaatgctacagacagagggcagcaagcgcgcgagtgcaagcaaatcccataaactgtggctcagttcagattgcaggctgcaactcgcctgcatgaaggcggaatcgctagtaatcgcaggtcagcatactgcggtgaatacgttcccgggccttgtacacaccgcccgtcacaccatgggagttggccacgcccgaagtcgttactctaaccgttcgcggaggagggcgccgaaggcagggctgatgactggggtgaagtcgtaacaaggtagccgtaccggaaggtgtggctggatcacctcctttt

SEQ ID NO: 6073 - DNA, 1491 bp, Nodularia spumigena
  ref <308>: DATABASE ACCESSION NUMBER: NCBI ACCESSION: NZ_CP020114.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtgtcttcggacatagtggcggacgggtgagtaacgcgtgagaatctagcttcaggtcggggacaaccacgggaaactgtggctaataccggatatgccgagaggtgaaaggcttgctgcctgaagatgagctcgcgtctgattagctagtaggtgtggtaaaagcgcacctaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaaaaaaatgacggtacctgaggaataagcatcggctaactccgtgccagcagccgcggtaatacggaggatgcaagcgttatccggaatgattgggcgtaaagggtccgcaggtggctatgtaagtctgctgttaaagaatctagctcaactagataaaagcagtggaaactacaaggctagagtgcgttcggggtagagggaattcctggtgtagcggtgaaatgcgtagatatcaggaagaacaccagtggcgaaggcgctctactaggccgcaactgacactgagggacgaaagctaggggagcgaatgggattagataccccagtagtcctagccgtaaacgatggatactaggcgtggctcgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatctctctgaaaggagagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacaaagggcagctacacagcaatgtgatgcaaatctcacaaaaccgtagctcagttcagatcgcaggctgcaactcgcctgcgtgaagtcggaatcgctagtaattgcaggtcagcatactgcagtgaattcgttcccgggccttgtacacaccgcccgtcacaccatggaagctggtcacgcccgaagtcgttaccccaactgttcgcagagggggatgccgaaggcaggactggtgactggggtgaagtcgtaacaaggtagccgtaccggaaggtgtggctggatcacctcctttt

SEQ ID NO: 6074 - DNA, 1530 bp, Nonomuraea polychroma
  ref <308>: DATABASE ACCESSION NUMBER: NCBI ACCESSION: NZ_SAUN01000001.1
  ref <309>: DATABASE ENTRY DATE: 2019-04-01
  ref <313>: RELEVANT RESIDUES IN SEQ ID NO: (1)..(1530)
tgtttggagagtttgatcctggctcaggacgaacgctggcggcgtgcttaacacatgcaagtcgagcggaaaggcccttcggggtactcgagcggcgaacgggtgagtaacacgtgagcaacctgcccctgactctgggataagcccgggaaactgggtctaataccggatatgaccgccttcggcatcggatggtggtggaaagtttttcggttggggatgggctcgcggcctatcagcttgttggtggggtagtggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcagcagggacgaagttgacgtgtacctgcagaagaagcgccggctaactacgtgccagcagccgcggtaatacgtagggcgcaagcgttgtccggaattattgggcgtaaagagctcgtaggtggctggtcgcgtctgccgtgaaagcccgcagcttaactgcgggtctgcggtggatacgggccggctagaggtaggcaggggcaagtggaattcctggtgtagcggtgaaatgcgcagatatcaggaggaacaccggtggcgaaggcggcttgctgggccttacctgacgctgaggagcgaaagcgtggggagcgaacaggattagataccctggtagtccacgctgtaaacgttgggcgctaggtgtgggggtcttccacgatctccgtgccggagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcacccggacactcccagagatgggggcttcttcggactgggtgacaggtggtgcatggctgtcgtcagctcgtgtcgtgagatgttgggttaagtcccgcaacgagcgcaacccttgctccatgttgccagcacgcctcttcgggggtggtggggactcatgggggactgccggggtcaactcggaggaaggtggggatgacgtcaagtcatcatgccccttatgtcttgggctgcaaacatgctacaatggccggtacagagggttgcgataccgtgaggtggagcgaatccctaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagcccgtggcccaacccgtaaggggggggagcggtcgaaggtggggctggcgattgggacgaagtcgtaacaaggtagccgtaccggaaggtgcggctggatcacctcctttctaaggag

SEQ ID NO: 6075 - DNA, 1521 bp, Nonomuraea sp. WAC 01424
  ref <308>: DATABASE ACCESSION NUMBER: NCBI ACCESSION: NZ_QHHZ01000046.1
  ref <309>: DATABASE ENTRY DATE: 2019-04-01
  ref <313>: RELEVANT RESIDUES IN SEQ ID NO: (1)..(1521)
tgtttggagagtttgatcctggctcaggacgaacgctggcggcgtgcttaacacatgcaagtcgagcggaaaggcccttcggggtactcgagcggcgaacgggtgagtaacacgtgagcaacctgcccctgactctgggataagcccgggaaactgggtctaataccggatacgaccgcccccggcatcgggtggtggtggaaagtttttcggttggggatgggctcgcggcctatcagcttgttggtggggtagtggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcagcagggacgaagttgacgtgtacctgcagaagaagcgccggctaactacgtgccagcagccgcggtaatacgtagggcgcaagcgttgtccggaattattgggcgtaaagagctcgtaggtggctggtcgcgtctgccgtgaaagcccgcagcttaactgcgggtctgcggtggatacgggccggctagaggtaggtaggggcaagtggaattcctggtgtagcggtgaaatgcgcagatatcaggaggaacaccggtggcgaaggcggcttgctgggccttacctgacgctgaggagcgaaagcgtggggagcgaacaggattagataccctggtagtccacgctgtaaacgttgggcgctaggtgtgggacccttccacgggttccgtgccggagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcacccggaaagctctggagacagagccctcttcggactgggtgacaggtggtgcatggctgtcgtcagctcgtgtcgtgagatgttgggttaagtcccgcaacgagcgcaacccttgctccatgttgccagcacgcccttcggggtggtggggactcatgggggactgccggggtcaactcggaggaaggtggggatgacgtcaagtcatcatgccccttatgtcttgggctgcaaacatgctacaatggccggtacagagggctgcgaaaccgcgaggtggagcgaatccctaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagcccgtggcccaacccgtaagggggggagcggtcgaaggtggggctggcgattgggacgaagtcgtaacaaggtagccgtaccggaaggtgcggctggatcacctcctttct

SEQ ID NO: 6076 - DNA, 1571 bp, Nosocomiicoccus ampullae
  ref <308>: DATABASE ACCESSION NUMBER: NCBI ACCESSION: NZ_MBFG01000002.1
  ref <309>: DATABASE ENTRY DATE: 2019-04-01
  ref <313>: RELEVANT RESIDUES IN SEQ ID NO: (1)..(1571)
ctattatggagagtttgatcctggctcaggatgaacgctggcggcgtgcctaatacatgcaagtcgagcgcgacttcttataccgaaccttcgggttcactttaagagtcgagcggcggacgggtgagtaacacgtgggcaacctgcccttaagactgggataactacgggaaaccgtagctaataccggataacacttttaaacataagtttargagttaaaaggtggatktatctaycacttaaggatgggcctgcggcgcattagctagttggtgaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtcactgcttactgtgtgacggtacttaaccagaaagccacggctaactacgtgccagcagccgcggtaatacgtaggtggcaagcgttatccggaattattgggcgtaaagcgcgcgtaggcggcgaaataagtctgatgtgaaagcccccggctcaaccggggaaggtcattggaaactgtatcgcttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattgagttgggcactttagagtgactgccggtgacaaaccggaggaaggtggggatgacgtcaaatcatcatgccccttatgatttgggctacacacgtgctacaatgggcaggaacaaagggcagcgaaaccgtgaggtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccatatggagggagccgtcgaaggtgggactgatgattggggtgaagtcgtaacaaggtagccgtatcggaaggtgcggctggatcacctcctttctaaggaa

SEQ ID NO: 6077 - DNA, 1568 bp, Nosocomiicoccus massiliensis
  ref <308>: DATABASE ACCESSION NUMBER: NCBI ACCESSION: NZ_PNFT01000024.1
  ref <309>: DATABASE ENTRY DATE: 2019-04-01
  ref <313>: RELEVANT RESIDUES IN SEQ ID NO: (1)..(1568)
ttatggagagtttgatcctggctcaggatgaacgctggcggcgtgcctaatacatgcaagtcgagcgcgacttcttataccgaaccttcgggttcactttaagagtcgagcggcggacgggtgagtaacacgtgggcaacctgcccttaagactgggataactacgggaaaccgtagctaataccggataacacttttaaacataagtttaggagttaaaaggtggatttatctatcacttaaggatgggcctgcggcgcattagctagttggtgaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtcactgcttactgtgtgacggtacttaaccagaaagccacggctaactacgtgccagcagccgcggtaatacgtaggtggcaagcgttatccggaattattgggcgtaaagcgcgcgtaggcggcgaaataagtctgatgtgaaagccctcggctcaaccggggaaggtcattggaaactgtatcgcttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattgagttgggcactttagagtgactgccggtgacaaaccggaggaaggtggggatgacgtcaaatcatcatgccccttatgatttgggctacacacgtgctacaatgggcaggaacaaagggcagcgaaaccgtgaggtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccattaggagggagccgtcgaaggtgggactgatgattggggtgaagtcgtaacaaggtagccgtatcggaaggtgcggctggatcacctcctttctaaggaa

SEQ ID NO: 6078 - DNA, 1294 bp, Nosocomiicoccus sp. HMSC059G07
  ref <308>: DATABASE ACCESSION NUMBER: NCBI ACCESSION: NZ_KV820821.1
  ref <309>: DATABASE ENTRY DATE: 2019-04-01
  ref <313>: RELEVANT RESIDUES IN SEQ ID NO: (1)..(1294)
gaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtcactgcttactgtgtgacggtacttaaccagaaagccacggctaactacgtgccagcagccgcggtaatacgtaggtggcaagcgttatccggaattattgggcgtaaagcgcgcgtaggcggcgaaataagtctgatgtgaaagcccccggctcaaccggggaaggtcattggaaactgtatcgcttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattgagttgggcactttagagtgactgccggtgacaaaccggaggaaggtggggatgacgtcaaatcatcatgccccttatgatttgggctacacacgtgctacaatgggcaggaacaaagggcagcgaaaccgtgaggtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccatttggagggagccgtcgaaggtgggactgatgattggggtgaagtcgtaacaaggtagccgtatcggaaggtgcggctggatcacctcctttctaaggaa

SEQ ID NO: 6079 - DNA, 1571 bp, Nosocomiicoccus sp. HMSC067E10
  ref <308>: DATABASE ACCESSION NUMBER: NCBI ACCESSION: NZ_KV802744.1
  ref <309>: DATABASE ENTRY DATE: 2019-04-01
  ref <313>: RELEVANT RESIDUES IN SEQ ID NO: (1)..(1571)
ctattatggagagtttgatcctggctcaggatgaacgctggcggcgtgcctaatacatgcaagtcgagcgcgacttcttataccgaaccttcgggttcactttaagagtcgagcggcggacgggtgagtaacacgtgggcaacctgcccttaagactgggataactacgggaaaccgtagctaataccggataacacttttaaacataagtttaagagttaaaaggtggatttatctatcacttaaggatgggcctgcggcgcattagctagttggtgaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtcactgcttactgtgtgacggtacttaaccagaaagccacggctaactacgtgccagcagccgcggtaatacgtaggtggcaagcgttatccggaattattgggcgtaaagcgcgcgtaggcggcgaaataagtctgatgtgaaagcccccggctcaaccggggaaggtcattggaaactgtatcgcttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattcagttgggcactttagagtgactgccggtgacaaaccggaggaaggtggggatgacgtcaaatcatcatgccccttatgatttgggctacacacgtgctacaatgggcaggaacaaagggcagcgaaaccgtgaggtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccatttggagggagccgtcgaaggtgggactgatgattggggtgaagtcgtaacaaggtagccgtatcggaaggtgcggctggatcacctcctttctaaggaa

SEQ ID NO: 6080 - DNA, 963 bp, Nosocomiicoccus sp. HMSC09A07
  ref <308>: DATABASE ACCESSION NUMBER: NCBI ACCESSION: NZ_KV793637.1
  ref <309>: DATABASE ENTRY DATE: 2019-04-01
  ref <313>: RELEVANT RESIDUES IN SEQ ID NO: (1)..(963)
cacttaaggatgggcctgcggcgcattagctagttggtgaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtcactgcttactgtgtgacggtacttaaccagaaagccacggctaactacgtgccagcagccgcggtaatacgtaggtggcaagcgttatccggaattattgggcgtaaagcgcgcgtaggcggcgaaataagtctgatgtgaaagcccccggctcaaccggggaaggtcattggaaactgtatcgcttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattgagttgggcactttagagtgactgccggtgacaaaccggaggaagg

SEQ ID NO: 6081 - DNA, 1491 bp, Nostoc commune
  ref <308>: DATABASE ACCESSION NUMBER: NCBI ACCESSION: NZ_BDUD01000001.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtgctttagggcacagtggcggacgggtgagtaacgcgtgagaatctggcttcaggtctgggacaaccactggaaacggtggctaataccggatgtgccgaaaggtgaaagattaattgcctggagatgagctcgcgtctgattagctagtaggtgtggtaaaggcgcacctaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaaaaaaatgacggtacctgaggaataagcatcggctaactccgtgccagcagccgcggtaatacggaggatgcaagcgttatccggaatgattgggcgtaaagcgtccgcaggtggctgtgtaagtctgctgttaaagagtctagctcaactagataagagcagtggaaactacacggctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcttctcgaaagggaagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcgggcgaccgcaagcaaatcccggaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaactgtcaaaagaggaggatgcctaaggcaggactggtgactggggtgaagtcgtaacaaggtagccgtaccggaaggtgtggctggatcacctccttttt

SEQ ID NO: 6082 - DNA, 1490 bp, Nostoc cycadae
  ref <308>: DATABASE ACCESSION NUMBER: NCBI ACCESSION: NZ_DF978477.1
  ref <309>: DATABASE ENTRY DATE: 2019-04-01
  ref <313>: RELEVANT RESIDUES IN SEQ ID NO: (1)..(1490)
aaaacggagagtttgatcctggctcaggatgaacgctggcggtatgcttaacacatgcaagtcgaacggtctcttcggagatagtggcggacgggtgagtaacgcgtgagaatctagcttcaggtcggggataactactggaaacggtggctaataccggatgtgccgaaaggtgaaaggcttgctgcctgaagatgagctcgcgtctgattagctagttggtgtggtaagagcgcaccaaggcgtcgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaataagaaagtgaaggtacctgaggaataagcatcggctaactccgtgccagcagccgcggtaatacggaggatgcaagcgttatccggaatgattgggcgtaaagcgtccgcaggtggcgatgtaagtctgctgttaaagagcaaagcttaactttgtaaaagcagtggaaactacatagctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgttgcgagtatcgaccctcgcagtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcctcttgaaagggaggagtgccttagggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacgaacagagggcagcaagctagcgatagcaagcaaatcccggaaatcgtagctcagttcagatcgaagcttgcaactcagcttcgtgaaggaggaatcgctagtaattgcaggtcagcatactgcagtgaattcgttcccgggccttgtacacaccgcccgtcacaccatggaagctggcaacgcccgaagtcattaccccaacttttaggagagggggatgcctaaggcagtgctggtgactggggtgaagtcgtaacaaggtagccgtaccggaaggtgtggctggatcacctcctttt

SEQ ID NO: 6083 - DNA, 1491 bp, Nostoc flagelliforme
  ref <308>: DATABASE ACCESSION NUMBER: NCBI ACCESSION: NZ_CP024785.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtgttttcggacacagtggcggacgggtgagtaacgcgtgagaatctggctttaggtctgggacaaccactggaaacggtggctaataccggatgtgccgaaaggtgaaaggttaactgcctgaagatgagctcgcgtctgattagctagtaggtgtggtaaaggcgcacctaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggctgtgtaagtctgctgttaaagagtctagctcaactagataagagcagtggaaactacacggctagagtacgttcggggcagagggaattcctggtgtagcggtgaaatgcgtagagatcaggaagaacaccagtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcctggtgaaagccgggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcatgcgaatgcaagcaaatcccgtaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattacttcaacctttcggggagaaggatgcctaaggcaggactggtgactggggtgaagtcgtaacaaggtagccgtaccggaaggtgtggctggatcacctccttttt

SEQ ID NO: 6084 - DNA, 1520 bp, Nostoc linckia
  ref <308>: DATABASE ACCESSION NUMBER: NCBI ACCESSION: NZ_LAHH01000440.1
  ref <309>: DATABASE ENTRY DATE: 2019-04-01
  ref <313>: RELEVANT RESIDUES IN SEQ ID NO: (1)..(1520)
tacgatgaagagtttgatcctggctcaggatgaacgctagcggcaggcctaacacatgcaagtcgaggggtagaagtcttcggactttgagaccggcgcacgggtgcgtaacgcgtatgcaatctgccttacactaagggatagcccagagaaatttggattaataccttatagtatattgatgtggcatcacattattattaaagatttatcggtgtaagatgagcatgcgtcccattagctagttggtatggtaacggcataccaaggcaatgatgggtaggggtcctgagagggagatcccccacactggtactgagacacggaccagactcctacgggaggcagcagtgaggaatattggtcaatggtcgcaagactgaaccagccatgccgcgtgcaggatgaagcatctatggtgtgtaaactgcttttgtacgggaagaaacaccccttcgtgaaggggcttgacggtaccgtaagaataaggatcggctaactccgtgccagcagccgcggtaatacggaggatccragcgttatccggaatcattgggtttaaagggtccgtaggcggttttktaagtcagwggtgaaatcckgcagctcaactgtcgaactgccattgatactgcaggacttgaattactgtgaagtaactagaatatgtagtgtagcggtgaaatgcwtagatattacatrgaataccrattgcgaaggcagrttactaacawtataytgacgctgatggacgaaagcgtggggagcgaacaggattagataccctggtagtccacgccgtaaacgatggwtactagctgtttggttgtaagactgagtggctaagcgaaagtgataagtatcccacctggggagtacgskcgcaagmstgaaactcaaakgaattgacgggggcccgcacaagcggtggagcatgtggtttaattcgatgatacgcgaggaaccttaccagggcttaaatgtagtgggacaggcttggaaacaggyccttcttcggactcattacaaggtgctgcatggttgtcgtcagctcgtgccgtgaggtgtcaggttaagtcctataacgagcgcaacccctgtcgttagttgccagcgagtcatgtcgggaactctaacgagactgccggtgcaaaccgtgaggaaggtggggatgacgtcaaatcatcacggcccttacgtcctgggctacacacgtgctacaatggccggtacagagagcagccaccccgcgagggggagcgaatctataaagccggtcacagttcggattggagtctgcaacccgactccatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactggtaactggggctaagtcgtaacaaggtagccgtaccggaaggtgcggctggaacacctcctttcta

SEQ ID NO: 6085 - DNA, 1487 bp, Nostoc piscinale
  ref <308>: DATABASE ACCESSION NUMBER: NCBI ACCESSION: NZ_CP012036.1
  ref <309>: DATABASE ENTRY DATE: 2019-04-01
  ref <313>: RELEVANT RESIDUES IN SEQ ID NO: (1)..(1487)
aaaacggagagtttgatcctggctcaggatgaacgctggcggtatgcttaacacatgcaagtcgaacggaatcttaggattcagtggcggacgggtgagtaacgcgtgagaatctagcttcaggtcggggataactactggaaacggtggctaataccggatgtgccgagaggtgaaaggctagctgcctgaagatgagctcgcgtctgattagctagttggtgtggtaagagcgcaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcaaggaagaaaaaatgacggtacttgaggaataagcatcggctaactccgtgccagcagccgcggtaatacggaggatgcaagcgttatccggaatgattgggcgtaaagcgtccgcaggtggcgatgtaagtctgctgttaaagagtctagcttaactagataaaagcagtggaaactacatagctagagtgcgttcggggtagagggaattcctggtgtagcggtgaaatgcgtagagatcaggaagaacaccggtggcgaaggcgctctactaggccgcaactgacactgagggacgaaagctaggggagcgaatgggattagataccccagtagtcctagccgtaaacgatggatactaggcgttgcgagtatcgaccctcgcagtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatccttgtgaaagcagggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctccgaacagagggcagcgagctagcgatagcaagcaaatcccggaaatcggagctcagttcagatcgaaggctgcaactcgccttcgtgaaggaggaatcgctagtaattgcaggtcagcatactgcagtgaattcgttcccgggccttgtacacaccgcccgtcacaccatggaagctggcaacgcccgaagtcattaccccaaccgtgaggagggggatgcctaaggcagtgctggtgactggggtgaagtcgtaacaaggtagccgtaccggaaggtgtggctggatcacctcctttt

SEQ ID NO: 6086 - DNA, 1497 bp, Nostoc punctiforme
  ref <308>: DATABASE ACCESSION NUMBER: NCBI ACCESSION: NC_010628.1
  ref <309>: DATABASE ENTRY DATE: 2019-04-01
  ref <313>: RELEVANT RESIDUES IN SEQ ID NO: (1)..(1497)
aaaacggagagtttgatcctggctcaggatgaacgctggcggtatgcttaacacatgcaagtcgaacggtgtcttcggacacagtggcggacgggtgagtaacgcgtgagaatctggctctaggtctgggacaaccactggaaacggtggctaataccggatgtgccgagaggtgaaaggttaactgcctagagatgagctcgcgtctgattagctagtaggtagtgtaatggactacctaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggcaatgtaagtctgctgttaaagagtctagctcaactagatacaagcagtggaaactacatagctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcctggtgaaagccgggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcatgcgaatgcaagcaaatcccgtaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaacctttcggggaggaggatgcctaaggcaggactggtgactggggtgaagtcgtaacaaggtagccgtaccggaaggtgtggctggatcacctcctttttagggag

SEQ ID NO: 6087 - DNA, 1219 bp, Nostoc sp. 106C
  ref <308>: DATABASE ACCESSION NUMBER: NCBI ACCESSION: NZ_MTAW01000008.1
  ref <309>: DATABASE ENTRY DATE: 2019-04-01
  ref <313>: RELEVANT RESIDUES IN SEQ ID NO: (1)..(1219)
gatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaaaacaatgacggtacctgaggaataagcatcggctaactccgtgccagcagccgcggtaatacggaggatgcaagcgttatccggaatgattgggcgtaaagcgtccgcaggtggcgatgtaagtctgctgttaaagagtgaggctcaacctcataagagcagtggaaactacattgctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatccctgtgaaagtagggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacaaagggcagcgagcgtgcgaacgcaagcaaatctcataaaccgtggctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcattactccaaccattcgtgggggaggatgcctaaggcaggactggtgactggggtgaagtcgtaacaaggtagccgtaccggaaggtgtggctggatcacctcctttt

SEQ ID NO: 6088 - DNA, 898 bp, Nostoc sp. 3335mG
  ref <308>: DATABASE ACCESSION NUMBER: NCBI ACCESSION: NZ_QHKA01000550.1
  ref <309>: DATABASE ENTRY DATE: 2019-04-01
  ref <313>: RELEVANT RESIDUES IN SEQ ID NO: (1)..(898)
tcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggttt

SEQ ID NO: 6089 - DNA, 1491 bp, Nostoc sp. ATCC 53789
  ref <308>: DATABASE ACCESSION NUMBER: NCBI ACCESSION: NZ_LWSY01000067.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtgtcttcggacacagtggcggacgggtgagtaacgcgtgagaatctggctctaggtctgggacaaccactggaaacggtggctaataccggatgtgccgagaggtgaaaggttaactgcctagagatgagctcgcgtctgattagctagttggaagtgtaatggactcccaaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggcaatgtaagtctgctgttaaagagtctagctcaactagataaaagcagtggaaactacatagctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcttcttgaaagggaagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcatgcgaatgcaagcaaatcccgtaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaaccattcgtggaggaggatgcctaaggcaggactggtgactggggtgaagtcgtaacaaggtagccgtaccggaaggtgtggctggatcacctccttttt

SEQ ID NO: 6090 - DNA, 1490 bp, Nostoc sp. CENA543
  ref <308>: DATABASE ACCESSION NUMBER: NCBI ACCESSION: NZ_CP023278.1
  ref <309>: DATABASE ENTRY DATE: 2019-04-01
  ref <313>: RELEVANT RESIDUES IN SEQ ID NO: (1)..(1490)
aaaacggagagtttgatcctggctcaggatgaacgctggcggtatgcttaacacatgcaagtcgaacggaatcttaggattcagtggcggacgggtgagtaacgcgtgagaatctagctctaggtcggggacaaccactggaaacggtggctaataccggatgtgccgaaaggtaaaaggcttgctgcctagagatgagctcgcgtctgattagctagttggtgtggtaagagcgcaccaaggtgacgatcagtagctggtctgagaggatgatcagccacactgggactgagacacgacccagactcctacgggaggcagcagtggggaattttccgcaatgggcgaaagcctgacggagcaataccgcgtgagggaggaaggctcttgggttgtaaacctcttttctcaaggaataagaaagtgaaggtacttgaggaataagcatcggctaactccgtgccagcagccgcggtaatacggaggatgcaagcgttatccggaatgattgggcgtaaagggtccgcaggtggcattgaaagtctgctgttaaagagtgaggcttaacctcataaaagcagtggaaactacaaagctagagtgcgttcggggtagcaggaattcctggtgtagcggtgaaatgcgtagagatcaggaagaacaccggtggcgaaagcgtgctactaggccgtaactgacactgagggacgaaagctaggggagcgaatgggattagataccccagtagtcctagccgtaaacgatggatactaggcgtggcttgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatttccctgaaagggggaagtgccttagggagcgcgaacacaggtggtgcatggctgtcgtcagctcgtgtcgtgagatgttgggttaagtcccgcaacgagcgcaaccctcgtctttagttgccagcattaagttgggaactctagagagactgccggtgacaaaccggaggaaggtggggatgacgtcaagtcagcatgccccttacgtcttgggctacacacgtactacaatgctacggacaaagggcagctacacagcgatgtgatgcaaatctcagaaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagctggtcacgcccgaagtcattacctcaacctttcgaggagggggatgcctaaggtaggactggtgactggggtgaagtcgtaacaaggtagccgtaccggaaggtgtggctggatcacctcctttt

SEQ ID NO: 6091 - DNA, 1500 bp, Nostoc sp. KVJ20
  ref <308>: DATABASE ACCESSION NUMBER: NCBI ACCESSION: NZ_KV757645.1
  ref <309>: DATABASE ENTRY DATE: 2019-04-01
  ref <313>: RELEVANT RESIDUES IN SEQ ID NO: (1)..(1500)
aaaacggagagtttgatcctggctcaggatgaacgctggcggtatgcttaacacatgcaagtcgaacgaaatctttcgggatttagtggcggacgggtgagtaacgcgtgagaatctgccttcaggtctgggacaaccactggaaacggtggctaataccggatgtgcccttaggggtgaaagattaattgcctgaagatgagctcgcgtctgattagctagtaggtagtgtaaaggactacctaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggctatgtaagtctgctgttaaagagtctagctcaactagataagagcagtggaaactacatggctagagtgcgttcggggcagagggaattcctggtgtagcggtgaaatgcgtagagatcaggaagaacaccggtggcgaaggcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatccgggtgaaagccgggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcatgcgaatgcaagcaaatcccgtaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaacctttcggggaggaggatgcctaaggcaggactggtgactggggtgaagtcgtaacaaggtagccgtaccggaaggtgtggctggatcacctcctttttaggga

SEQ ID NO: 6092 - DNA, 1492 bp, Nostoc sp. Lobaria pulmonaria 5183 cyanobiont
  ref <308>: DATABASE ACCESSION NUMBER: NCBI ACCESSION: NZ_CP026692.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacgaactcttcggagttagtggcggacgggtgagtaacgcgtgagaatctggcttctggtctgggacaaccactggaaacggtggctaataccggatgtgccgtaaggtgaaaggttaactgccagaagatgagctcgcgtctgattagctagttggtagagtaagagcctaccaaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggcaatgtaagtctgctgttaaagagtctagctcaactagatacaagcagtggaaactacatagctagagtacgttcggggcagagggaattcctggtgtagcggtgaaatgcgtagagatcaggaagaacaccagtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcctggtgaaagctgggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagctaccacgcgagtgcaagcaaatcccgcaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactcaaaccgttcgcgggggaggatgcctaaggcaggactggtgactggggtgaagtcgtaacaaggtagccgtaccggaaggtgtggctggatcacctccttttta

SEQ ID NO: 6093 - DNA, 1491 bp, Nostoc sp. NIES-3756
  ref <308>: DATABASE ACCESSION NUMBER: NCBI ACCESSION: NZ_AP017295.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtctcttcggagatagtggcggacgggtgagtaacgcgtgagaatctggctccaggtcggggacaacagttggaaacgactgctaataccggatgtgccgagaggtaaaagatttattgcctggagatgagctcgcgtctgattagctagttggtgtggtaagagcgcaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcaaggaataaaaaaatgaaggtacttgaggaataagcatcggctaactccgtgccagcagccgcggtaatacggaggatgcaagcgttatccggaatgattgggcgtaaagggtccgcaggtggcagtgtaagtctgctgtcaaagaatgaggcttaacctcatcaaggcagtggaaactacacagctagagtacggtcggggtagaaggaattcctggtgtagcggtgaaatgcgtagagatcaggaagaacaccggtggcgaaagcgttctgctagacctgtactgacactgagggacgaaagctaggggagcgaatgggattagataccccagtagtcctagccgtaaacgatggatactaggcgtggcttgtatcgacccgagccgtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcttcctgaaagggaagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacagagggcagcaagctagcgatagcaagcaaatcccgtaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggcaacgcccgaagtcattactccaaccgtaagggggaggatgcctaaggcagtgctggtgactggggtgaagtcgtaacaaggtagccgtaccggaaggtgtggctggatcacctcctttttag

SEQ ID NO: 6094 - DNA, 1492 bp, Nostoc sp. PCC 7107
  ref <308>: DATABASE ACCESSION NUMBER: NCBI ACCESSION: NC_019676.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggtcttttcggagatagtggcggacgggtgagtaacgcgtgagaatctagcttcaggtcggggataactactggaaacggtggctaataccggatgtgccgaaaggtaaaaggcttgctgcctgaagatgagctcgcgtctgattagctagttggtgtggtaagagcgcaccaaggcgtcgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaaacctcttttctcaaggaataaaaaaaatgaaggtacttgaggaataagcatcggctaactccgtgccagcagccgcggtaatacggaggatgcaagcgttatccggaatgattgggcgtaaagcgtccgcaggtggcgatgtaagtctgctgttaaagagcaaagcttaactttgtaaaagcagtggaaactacatagctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgttgcgagtatcgaccctcgcagtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcctcttgaaagggaggagtgccttagggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacgaacagagggcagcaagctagcgatagcaagcaaatcccggaaatcgtagctcagttcagatcgaagcttgcaactcagcttcgtgaaggaggaatcgctagtaattgcaggtcagcatactgcagtgaattcgttcccgggccttgtacacaccgcccgtcacaccatggaagctggcaacgcccgaagtcattaccccaacttttaggagagggggatgcctaaggcagtgctggtgactggggtgaagtcgtaacaaggtagccgtaccggaaggtgtggctggatcacctcctttt

SEQ ID NO: 6095 - DNA, 1489 bp, Nostoc sp. PCC 7120
  ref <308>: DATABASE ACCESSION NUMBER: NCBI ACCESSION: NZ_RSCN01000112.1
  ref <309>: DATABASE ENTRY DATE: 2019-04-01
  ref <313>: RELEVANT RESIDUES IN SEQ ID NO: (1)..(1489)
aaacggagagtttgatcctggctcaggatgaacgctggcggtatgcttaacacatgcaagtcgaacggtctcttcggagatagtggcggacgggtgagtaacgcgtgagaatctagcttcaggtcggggacaaccactggaaacggtggctaataccggatgtgccgaaaggtgaaagatttattgcctgaagatgagctcgcgtctgattagctagttggtgtggtaagagcgcaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaataaaaaaatgaaggtacctgaggaataagcatcggctaactccgtgccagcagccgcggtaatacggaggatgcaagcgttatccggaatgattgggcgtaaggcgtccgcaggtggcactgtaagtctgctgttaaagagcaaggctcaaccttgtaaaggcagtggaaactacagagctagagtacgttcggggcagagggaattcctggtgtagcggtgaaatgcgtagagatcaggaagaacaccgggggcgaaagcgctctgctaggccgtaactgacactgagggacgaaagctaggggagcgaatgggattagataccccagtagtcctagccgtaaacgatggatactaggcgtggcttgtatcgacccgagccgtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcttcttgaaagggaagagtgccttagggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacagagggcagcaagctagcgatagcaagcaaatcccgtaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggcaacgcccgaagtcattactccaacttttaggagaggaggatgcctaaggcagtgctggtgactggggtgaagtcgtaacaaggtagccgtaccggaaggtgtggctggatcacctcctttt

SEQ ID NO: 6096 - DNA, 1489 bp, Nostoc sp. PCC 7524
  ref <308>: DATABASE ACCESSION NUMBER: NCBI ACCESSION: NC_019684.1
  ref <309>: DATABASE ENTRY DATE: 2019-04-01
  ref <313>: RELEVANT RESIDUES IN SEQ ID NO: (1)..(1489)
aaaacggagagtttgatcctggctcaggatgaacgctggcggtatgcttaacacatgcaagtcgaacggtcttttcggagatagtggcggacgggtgagtaacacgtgagaatctgcattcaggtcggggacaaccactggaaacggtggctaataccggatgtgccgagaggtgaaaggcttgctgcctgaaaatgagctcgcgactgattagctagttggtagtgtaagggactaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcaaggaataagatatgaaggtacttgaggaataagcatcggctaactccgtgccagcagccgcggtaatacggaggatgcaagcgttatccggaatgattgggcgtaaagagtccgtaggtggttgtgaaagtctgctgttaaagagcaaggctcaaccttgtaaaggcagtggaaactacacagctagagtgcgttcggggcagaaggaattcctggtgtagcggtgaaatgcgtagagatcaggaagaacaccggtggcgaaagcgttctgctaggccgtgactgacactgagggacgaaagctaggggagcgaatgggattagataccccagtagtcctagccgtaaacgatggatactaggcgtggcttgtatcgacccgagccgtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcttcttgaaaggggagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacaaagggcagcaagctagcgatagcaagcaaatctcacaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggcaacgcccgaagtcattactccaaccattcgtggaggaggatgcctaaggcagtgctggtgactggggtgaagtcgtaacaaggtagccgtaccggaaggtgtggctggatcacctcctttt

SEQ ID NO: 6097 - DNA, 1491 bp, Nostoc sp. Peltigera membranacea cyanobiont N6
  ref <308>: DATABASE ACCESSION NUMBER: NCBI ACCESSION: NZ_CP026681.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggtgctttcgggcacagtggcggacgggtgagtaacgcgtgagaatctggctctaggtctgggacaaccactggaaacggtggctaataccggatgtgccgagaggtgaaaggttaactgcctagagatgagctcgcgtctgattagctagttggaagtgtaatggactcccaaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaacaaaatgacggtacctgaggaataagcatcggctaactccgtgccagcagccgcggtaatacggaggatgcaagcgttatccggaatgattgggcgtaaagcgtccgcaggtggctatgtaagtctgctgttaaagagtctagctcaactagataagagcagtggaaactacaaggctagagtacgttcggggcagagggaattcctggtgtagcggtgaaatgcgtagagatcaggaagaacaccggtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaatcttcttgaaagggaagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagcatgcgaatgcaagcaaatcccggaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaacccttcggggaggaggatgcctaaggcaggactggtgactggggtgaagtcgtaacaaggtagccgtaccggaaggtgtggctggatcacctccttttt

SEQ ID NO: 6098 - DNA, 1545 bp, Nostoc sp. RF31Y
  ref <308>: DATABASE ACCESSION NUMBER: NCBI ACCESSION: NZ_MTAX01000014.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggcaggcctaacacatgcaagtcgaacggcagcacaggagagcttgctctctgggtggcgagtggcggacgggtgaggaatacatcggaatctactttttcgtgggggataacgtagggaaacttacgctaataccgcatacgaccttcgggtgaaagcaggggaccttcgggccttgcgcgattaaatgagccgatgtcggattagctagttggtggggtaaaggctcaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcgattaatactcgattgttctgacggtacccaaagaataagcaccggctaacttcgtgccagcagccgcggtaatacgaagggtgcaagcgttactcggaattactgggcgtaaagcgtgcgtaggtggtgatttaagtccgttgtgaaagccctgggctcaacctgggaattgcagtggatactgggtcactagagtgtggtagagggtagcggaattcccggtgtagcagtgaaatgcgtagagatcgggaggaacatctgtggcgaaggcggctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaatcccgcgagggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 6099 - DNA, 1493 bp, Nostoc sphaeroides
  ref <308>: DATABASE ACCESSION NUMBER: NCBI ACCESSION: NZ_CP031941.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacgaaatctttcgggatttagtggcggacgggtgagtaacgcgtgagaatctggctctaggtctgggacaaccactggaaacggtggctaatactggatgtgccgaaaggtgaaaggttaactgcctggagatgagctcgcgtctgattagctagtaggtgtggtaagagcgcacctaggcgacgatcagtagctggtctgagaggacgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaagacaatgacggtacctgaggaataagcatcggctaactccgtgccagcagccgcggtaatacggaggatgcaagcgttatccggaatgattgggcgtaaagcgtccgcaggtggcgatgtaagtctgctgttaaagagtctagctcaactagataagagcagtggaaactacatagctagagtacgttcggggcagagggaattcctggtgtagcggtgaaatgcgtagagatcaggaagaacaccagtggcgaaggcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgccggcaacggtgaaactcaaaggaattgacgggggcccgcacaagcggtggagtatgtggtttaattcgatgcaacgcgaagaaccttaccaaggcttgacatgtcgcgaattggagtgaaagcttcaagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgccttgggctacacacgtactacaatgctccggacagagggcagcaagatagcgatgtcaagcaaatcccacaaaccggagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattactccaaccattcgtggaggaggatgcctaaggcaggactggtgactggggtgaagtcgtaacaaggtagccgtaccggaaggtgtggctggatcacctccttttt

SEQ ID NO: 6100 - DNA, 1494 bp, Notoacmeibacter sp. M2BS9Y-3-1
  ref <308>: DATABASE ACCESSION NUMBER: NCBI ACCESSION: NZ_RCWN01000001.1
  ref <309>: DATABASE ENTRY DATE: 2019-04-01
  ref <313>: RELEVANT RESIDUES IN SEQ ID NO: (1)..(1494)
tcaacatgagagtttgatcctggctcagaacgaacgctggcggcaggcttaacacatgcaagtcgaacgatcccttcggggatagtggcagacgggtgagtaacgcgtgggaatctaccccaaggtacgggataacagttggaaacgactgctaataccgtatgtgtcctccgggacaaagatttatcgccttgggacgagcccgcgttggattagctagttggtggggtaatggcctaccaaggcgacgatccatagctggtctgagaggatgatcagccacattgggactgagacacggcccaaactcctacgggaggcagcagtggggaatattggacaatgggggaaaccctgatccagccatgccgcgtgagtgatgaaggccctagggttgtaaagctctttcgccggtgaagataatgacggtaaccggtaaagaagccccggctaacttcgtgccagcagccgcggtaatacgaagggggctagcgttgttcggaattactgggcgtaaagcgcacgtaggcggaccatttagtcaggggtgaaatcccggggctcaaccccggaactgcctttgatactgatggtcttgaggtcgagagaggtgagtggaattgcgagtgtagaggtgaaattcgtagatattcgcaggaacaccagtggcgaaggcggctcactggctcgatactgacgctgaggtgcgaaagcgtggggagcaaacaggattagataccctggtagtccacgccgtaaacgatgaatgccagccgtcgggggatttatccttcggtggcgcagttaacgctttgagcattccgcctggggagtacggtcgcaagattaaaactcaaaggaattgacgggggcccgcacaagcggtggagcatgtggtttaattcgaagcaacgcgcagaaccttaccagcccttgacataccgatcgcggttaccggagacggtttccttcagttcggctggatcggatacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgggtgcatgaagttggaatcgctagtaatcgcggatcagcatgccgcggtgaatacgttcccgggccttgtacacaccgcccgtcacaccatgggagttgggtctgcccgaaggcggtgcgccaacctttttaggaggcagccgaccacggtaggctcagcgactggggtgaagtcgtaacaaggtagccgtaggggaacctgcggctggatcacctcctttctaa

SEQ ID NO: 6101 - DNA, 1563 bp, Novibacillus thermophilus
  ref <308>: DATABASE ACCESSION NUMBER: NCBI ACCESSION: NZ_CP019699.1
  ref <309>: DATABASE ENTRY DATE: 2019-04-01
  ref <313>: RELEVANT RESIDUES IN SEQ ID NO: (1)..(1563)
tttaatggagagtttgatcctggctcaggacgaacgctggcggcgtgcctaatacatgcaagtcgtgcgggtgaagccgaccaccccttcgggggcggatggtggaaccagcggcggacgggtgagtaacacgtgggcaacctgcctgcaagaccgggataactgcgggaaaccggagctaataccggataagaggcttttccgcatgggggagccttaaaaggcggcggaagtcgtcacttgcagatgggcccgcggcgcattagctagttggtgagggaagggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgagcgaggacggccttcgggttgtaaagctctgtcatgtgggaagaacggctaggagagggcatgctcttagcgtgacggtaccacaggaggaagccccggctaactacgtgccagcagccgcggtaacacgtagggggcgagcgttgtccggaattattgggcgtaaagggcgcgcaggcggtctcttaagtctgatgtgaaaggccacggctcaaccgtgggatggcattggaaactgggggacttgagtgcaggagaggggagcggaattcccggtgtagcggtgaaatgcgtagagatcgggaggaacaccagtggcgaaggcggctctctggcctgtaactgacgctgaggcgcgaaagcgtggggagcgaacaggattagataccctggtagtccacgccgtaaacgatgagtgctaggtgttaggggcgtcacgcccttagtgccgaagtaaacacattaagcactccgcctggggagtacggccgcaaggctgaaactcaaaggaattgacgggggcccgcacaagcggtggagcatgtggtttaattcgaagcaacgcgaagaaccttaccagggcttgacatcctctgacccctctagagatagaggtttcccttcggggacagagagacaggtggtgcatggttgtcgtcagctcgtgtcgtgagatgttgggttaagtcccgcaacgagcgcaacccttgagcttagttgccagcattgagttgggcactctaagctgactgccagtgacaagctggaggaaggtggggatgacgtcaaatcatcatgccccttatgtcctgggcgacacacgtgctacaatggctggtacagagggcagcgaagcggtgacgcggagccaatcccagaaagccagtctcagttcggatcgcaggctgcaactcgcctgcgtgaaggaggaatcgctagtaatcgcggatcagcatgccgcggtgaatacgttcccgggccttgtacacaccgcccgtcacaccacgagagtctgtaacacccgaagtcggtgaggcaaccgtaaggagccagccgccgaaggtgggacagatgattggggtgaagtcgtaacaaggtagccgtatcggaaggtgcggctggatcacctcctttcta

SEQ ID NO: 6102 - DNA, 1542 bp, Noviherbaspirillum sp. K1S02-23
  ref <308>: DATABASE ACCESSION NUMBER: NCBI ACCESSION: NZ_QYUQ01000002.1
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctggcggcatgccttacacatgcaagtcgaacggcagcgcggacttcggtctggcggcgagtggcgaacgggtgagtaatatatcggaacgtgccctggagtgggggataacgcagcgaaagttgcgctaataccgcatacgatctacggatgaaagtgggggattcgcaagaacctcatgctcctggagcggccgatatctgattagctagttggtagggtaaaagcctaccaaggcatcgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggttctggataatacccgggactaatgacggtacctgaagaataagcaccggctaactacgtgccagcagccgcggtaatacgtagggtgcaagcgttaatcggaattactgggcgtaaagcgtgcgcaggcggttgtgtaagtctgtcgtgaaatccccgggctcaacctgggaattgcgatggagactgcacggctagagtgtgtcagaggggggtagaattccacgtgtagcagtgaaatgcgtagatatgtggaggaacaccgatggcgaaggcagccccctgggataacactgacgctcatgcacgaaagcgtggggagcaaacaggattagataccctggtagtccacgccctaaacgatgtcaactagttgtcgggtcttaattgacttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccctgctgagaggcgggggtgctcgaaagagagccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 6103 - DNA, 1471 bp, Novosphingobium acidiphilum
  ref <308>: DATABASE ACCESSION NUMBER: NCBI ACCESSION: NZ_AUBA01000045.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcatgcctaacacatgcaagtcgaacgagatccttcggggtctagtggcgcacgggtgcgtaacgcgtgggaatctgcccttgggttcggaataacagttagaaatgactgctaataccggatgatgtcttcggaccaaagatttatcgcccagggatgagcccgcgtaagattaggtagttggtggggtaaaggcctaccaagccgacgatctttagctggtctgagaggatgatcagccacactgggactgagacacggcccagactcctacgggaggcagcagtggggaatattggacaatgggggaaaccctgatccagcaatgccgcgtgagtgatgaaggccttcgggtcgtaaagctcttttacccgggatgataatgacagtaccgggagaataagccccggctaactccgtgccagcagccgcggtaatacggagggggctagcgttgttcggaattactgggcgtaaagcgcacgtaggcggttactcaagtcagaggtgaaagcccggggctcaaccccggaactgcctttgaaactaggtgactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctacgctacccagagagatttggggttcccttcggggacgtagagacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggttaatcccaaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 6104 - DNA, 1492 bp, Novosphingobium aromaticivorans
  ref <308>: DATABASE ACCESSION NUMBER: NCBI ACCESSION: NC_007794.1
  ref <309>: DATABASE ENTRY DATE: 2019-04-01
  ref <313>: RELEVANT RESIDUES IN SEQ ID NO: (1)..(1492)
caacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggtcacttggtgattgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacttccagagatggaaggttcccttcggggacgcggtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 6105 - DNA, 1497 bp, Novosphingobium barchaimii
  ref <308>: DATABASE ACCESSION NUMBER: NCBI ACCESSION: NZ_LDRW01000020.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttcggttgggaataactgagagaaatttcagctaataccttataatgtcttcggaccaaagatttatcgccgagggatgagcccgcgtaagattaggtagttggtggggtaatggcctaccaagccgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggtttctcaagtcagaggtgaaagcccggggctcaaccccggaactgcctttgaaactaggagactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacacgctgggctacacacgtgctacaatggcggtgacagtgagcagctaaccagcgatggtatgctaatctccaaaagccgtctcagttcggattgctctctgcaactcgggagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6106 - DNA, 276 bp, Novosphingobium capsulatum
  ref <308>: DATABASE ACCESSION NUMBER: NCBI ACCESSION: NZ_BCYV01000069.1
  ref <309>: DATABASE ENTRY DATE: 2019-04-01
  ref <313>: RELEVANT RESIDUES IN SEQ ID NO: (1)..(276)
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgacttcggtccaaagatttatcggcaaaggatgagcccgcgtaggattaggtagttggtggggtaaaggcctaccaagccgacgatccttagctggtctgagaggatgatca

SEQ ID NO: 6107 - DNA, 1490 bp, Novosphingobium fuchskuhlense
  ref <308>: DATABASE ACCESSION NUMBER: NCBI ACCESSION: NZ_KQ954244.1
  ref <309>: DATABASE ENTRY DATE: 2019-04-01
  ref <313>: RELEVANT RESIDUES IN SEQ ID NO: (1)..(1490)
aaacttgagagtttgatcctggctcagaacgaacgctggcggcatgcctaacacatgcaagtcgaacgagaccttcgggtctagtggcgcacgggtgcgtaacgcgtgggaatctgccctttgcttcggaataacagttagaaatgactgctaataccggatgatgtcttcggaccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagagtacgtaggcggttattcaagtcagaggtgaaagcccggggctcaaccccggaactgcctttgaaactagataactagagtcttggagaggttagtggaattccgagtgtagaggtgaaattcgtagatattcggaagaacaccagtggcgaaggcgactaactggacaagtactgacgctgaggtacgaaagcgtggggagcaaacaggattagataccctggtagtccacgccgtaaacgatgataactagttgttcggtcacttggtgactgagtgacgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacccagagagatttggggttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaaactcgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 6108 - DNA, 1495 bp, Novosphingobium guangzhouense
  ref <308>: DATABASE ACCESSION NUMBER: NCBI ACCESSION: NZ_LYMM01000093.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgatcccttcggggatagtggcgcacgggtgcgtaacgcgtgggaatctgccctttgcttcggaataacagtgagaaattactgctaataccggatgatgtcttcggaccaaagatttatcggcaagggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggattagagagatcttttccttcagttcggctggatgagtgacaggtgctgcatggctgtcgtcagctcgtgtcgtgagatgttgggttaagtcccgcaacgagcgcaaccctcgtccttagttgccagcatttagttgggcactctaaggaaactgccggtgataagccggaggaaggtggggatgacgtcaagtcctcatggcccttacacgctgggctacacacgtgctacaatggcggtgacagtgggcagcaagcaggcgactgcaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaag

SEQ ID NO: 6109 - DNA, 1493 bp, Novosphingobium kunmingense
  ref <308>: DATABASE ACCESSION NUMBER: NCBI ACCESSION: NZ_PHUF01000004.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgaagccttcgggcttagtggcgcacgggtgcgtaacgcgtgggaacctgcctttcggttcggaataacagttagaaatgactgctaataccggatgatgtcttcggaccaaagatttatcgccgaaagatgggcccgcgtaggattagctagttggtggggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgactcaagtcagaggtgaaagcccggggctcaaccccggaactgcctttgaaactaggtcgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacaggctgggctacacacgtgctacaatggcggtgacagtgggcagccactacgcgagtaggagctaatcccaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 6110 - DNA, 1493 bp, Novosphingobium lentum
  ref <308>: DATABASE ACCESSION NUMBER: NCBI ACCESSION: NZ_BCTW01000008.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgaagccttcgggcttagtggcgcacgggtgcgtaacgcgtgggaatctgcccctcggttcggaataacagttagaaatgactgctaataccggatgatgacgaaagtccaaagatttatcgccgagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggtcgtaaagctcttttaccagggatgataatgacagtacctggagaataagctccggctaactccgtgccagcagccgcggtaatacggagggagctagcgttgttcggaattactgggcgtaaagcgtacgtaggcggttattcaagtcagaggtgaaagcccggggctcaaccccggaactgcctttgaaactaggtaactagaatcttggagaggtcagtggaattccgagtgtagaggtgaaattcgtagatattcggaagaacaccagtggcgaaggcgactgactggacaagtattgacgctgaggtacgaaagcgtggggagcaaacaggattagataccctggtagtccacgccgtaaacgatgataactagctgtccgggcacttggtgcctgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctatccagagagatctggggttcccttcggggacgcggtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggcagcaaactcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 6111 - DNA, 1497 bp, Novosphingobium lindaniclasticum
  ref <308>: DATABASE ACCESSION NUMBER: NCBI ACCESSION: NZ_ATHL01000125.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagtgagaaattactgctaataccggatgatgtcttcggaccaaagatttatcgcccagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctgctcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttgagagatcatttccttcagttcggctggatgagtgacaggtgctgcatggctgtcgtcagctcgtgtcgtgagatgttgggttaagtcccgcaacgagcgcaaccctcgtccttagttgccagcatttggttgggcactctaaggaaactgccggtgataagccggaggaaggtggggatgacgtcaagtcctcatggcccttacacgctgggctacacacgtgctacaatggcggtgacagtgggcagcaagcaggcgactgcaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaactcgcaagagaggcaggcgaccacagtgggtttagcgactggggtgaagtcgtaacaaggtagccgtaggggaacctgcggctggatcacctcctttctaagga

SEQ ID NO: 6112 - DNA, 1497 bp, Novosphingobium malaysiense
  ref <308>: DATABASE ACCESSION NUMBER: NCBI ACCESSION: NZ_JTDI01000002.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaacccttcggggttagtggcgcacgggtgcgtaacgcgtgggaatctgcccttcggttcggaataactcagggaaacttgagctaataccggatgatgtcttcggaccaaagatttatcgccgaaggatgagcccgcgttagattaggtagttggtggggtaatggcctaccaagccgacgatctatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttaccagggatgataatgacagtacctggagaataagctccggctaactccgtgccagcagccgcggtaatacggagggagctagcgttgttcggaattactgggcgtaaagcgcgcgtaggcggtttttcaagtcagaggtgaaagcccggggctcaaccccggaactgcctttgaaactggatgactagaatcttggagaggcgagtggaattccgagtgtagaggtgaaattcgtagatattcggaagaacaccagtggcgaaggcgactcgctggacaagtattgacgctgaggtgcgaaagtgtggggagcaaacaggattagataccctggtagtccacaccgtaaacgatgataactagctgtccgggctcttggagtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcgattggcagagatgcctttcttcagttcggctggaccagtgacaggtgctgcatggctgtcgtcagctcgtgtcgtgagatgttgggttaagtcccgcaacgagcgcaaccctcgtccttagttgccaccatttagttgggcactctaaggaaactgccggtgataagccggaggaaggtggggatgacgtcaagtcctcatggcccttacaggctgggctacacacgtgctacaatggcggtgacagtgggcagcgagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctgcgttaacccgcaagggagacaggcgaccacggtgggatcagcgactggggtgaagtcgtaacaaggtagccgtaggggaacctgcggctggatcacctcctttctaagga

SEQ ID NO: 6113 - DNA, 1497 bp, Novosphingobium mathurense
  ref <308>: DATABASE ACCESSION NUMBER: NCBI ACCESSION: NZ_FVZE01000029.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgccctttgcttcggaataacagtgagaaattactgctaataccggatgatgtcttcggaccaaagatttatcggcaagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacacgctgggctacacacgtgctacaatggcggtgacagtgggcagcaagtgcgcgagcacaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggtagtgcgctaaccggcaacggaggcagctaaccacggtgggatcagcgactggggtgaagtcgtaacaaggtagccgtaggggaacctgcggctggatcacctcctttctaagga

SEQ ID NO: 6114 - DNA, 1497 bp, Novosphingobium naphthalenivorans
  ref <308>: DATABASE ACCESSION NUMBER: NCBI ACCESSION: NZ_BCTX01000153.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagtgagaaattactgctaataccggatgatgtcttcggaccaaagatttattgcccaaggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcgaatagcagagatgcttttcttcagttcggctggatcagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacacgctgggctacacacgtgctacaatggcggtgacagtgggcagcgagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 6115 - DNA, 1468 bp, Novosphingobium nitrogenifigens
  ref <308>: DATABASE ACCESSION NUMBER: NCBI ACCESSION: NZ_AQWK01000037.1
  ref <309>: DATABASE ENTRY DATE: 2019-04-01
  ref <313>: RELEVANT RESIDUES IN SEQ ID NO: (1)..(1468)
aacatgagagtttgatcctggctcagaacgaacgctggcggcatgcctaacacatgcaagtcgaacgatgccttcgggcatagtggcgcacgggtgcgtaacgcgtgggaatctgcctttgggtctgggataactcagggaaacttgagctaataccggatgatgactttggtccaaagatttatcgcccaaagatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttcgggtcgtaaagctcttttacccgggatgataatgacagtaccgggagaataagctccggctaactccgtgccagcagccgcggtaatacggagggagctagcgttgttcggaattactgggcgtaaagcgcacgtaggcggctactcaagtcagaggtgaaagcccggggctcaaccccggaactgcctttgaaactaggtggctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctacgctacccagagagatttggggttcccttcggggacgtagagacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggaaaatccccaaaaaccgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 6116 - DNA, 1494 bp, Novosphingobium panipatense
  ref <308>: DATABASE ACCESSION NUMBER: NCBI ACCESSION: NZ_MSQB01000072.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgagcccttcggggttagtggcgcacgggtgcgtaacgcgtgggaatctgcccttgggttcggaataacagtgagaaattactgctaataccggatgatgtcttcggaccaaagatttatcgcccaaggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctgctcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggtacttggtacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttgagagatcatttccttcagttcggctggatgagtgacaggtgctgcatggctgtcgtcagctcgtgtcgtgagatgttgggttaagtcccgcaacgagcgcaaccctcgtccttagttgccagcatttagttgggcactctaaggaaactgccggtgataagccggaggaaggtggggatgacgtcaagtcctcatggcccttacacgctgggctacacacgtgctacaatggcggtgacagtgggcagcaagtgcgcgagcacaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggctgtgcgctaaccgcaaggaggcagcagaccacggtgggatcagcgactggggtgaagtcgtaacaaggtagccgtaggggaacctgcggctggatcacctcctttctaagg

SEQ ID NO: 6117 - DNA, 1497 bp, Novosphingobium pentaromativorans
  ref <308>: DATABASE ACCESSION NUMBER: NCBI ACCESSION: NZ_CP009291.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttcggttcggaataactcagggaaacttgagctaataccggataatgacttcggtccaaagatttattgccgagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacacgctgggctacacacgtgctacaatggcggtgacagtgggcagcgagtgcgcgagcacaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggtagtgcgctaaccggcaacggaggcagctaaccacggtgggatcagcgactggggtgaagtcgtaacaaggtagccgtaggggaacctgcggctggatcacctcctttctaagga

SEQ ID NO: 6118 - DNA, 1495 bp, Novosphingobium resinovorum
  ref <308>: DATABASE ACCESSION NUMBER: NCBI ACCESSION: NZ_CP017075.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgagatcttcggatctagtggcgcacgggtgcgtaacgcgtgggaatctgcccttgggttcggaataacagtgagaaattactgctaataccggatgatgtcttcggaccaaagatttatcgcccagggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggtacttggtacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgccggtcgcggatttgggagaccatttccttcagttcggctggaccgtgcacaggtgctgcatggctgtcgtcagctcgtgtcgtgagatgttgggttaagtcccgcaacgagcgcaaccctcgtccttagttgccagcatttagttgggcactctaaggaaactgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6119 - DNA, 1495 bp, Novosphingobium rosa
  ref <308>: DATABASE ACCESSION NUMBER: NCBI ACCESSION: NZ_BCZE01000148.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgagaccttcgggtctagtggcgcacgggtgcgtaacgcgtgggaatctgccctttgcttcggaataacagttagaaatgactgctaataccggatgatgtcgcaagaccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggtacatcaagtcaggggtgaaagcccggagctcaactccggaactgcccttgaaactagtgtactagaatcttggagaggcgggtggaattccgagtgtagaggtgaaattcgtagatattcggaagaacaccagtggcgaaggcggcccgctggacaagtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6120 - DNA, 1491 bp, Novosphingobium sp. AAP1
  ref <308>: DATABASE ACCESSION NUMBER: NCBI ACCESSION: NZ_LJHO01000010.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgacttcggtccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtgactggaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccgcgctatatcgagagatcgatagttcccttcggggacgcggtgacaggtgctgcatggctgtcgtcagctcgtgtcgtgagatgttgggttaagtcccgcaacgagcgcaaccctcgtccttagttgccagcattaagttgggcactctaaggaaactgccggtgataagccggaggaaggtggggatgacgtcaagtcctcatggcccttacaggctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6121 - DNA, 1511 bp, Novosphingobium sp. AAP83
  ref <308>: DATABASE ACCESSION NUMBER: NCBI ACCESSION: NZ_LJHY01000006.1
  ref <309>: DATABASE ENTRY DATE: 2019-04-01
  ref <313>: RELEVANT RESIDUES IN SEQ ID NO: (1)..(1511)
caaacttgagagtttgatcctggctcagaacgaacgctggcggcatgcctaacacatgcaagtcgaacgaaggccccaattcttcggaggcggggtcttagtggcgcacgggtgcgtaacgcgtgggaatctgcccttgggttcggaataacagttagaaatgactgctaataccggatgatgacgaaagtccaaagatttatcgcccaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggggcaaccctgatccagcaatgccgcgtgagtgatgaaggccttagggtcgtaaagctcttttaccagggatgataatgacagtacctggagaataagctccggctaactccgtgccagcagccgcggtaatacggagggagctagcgttgttcggaattactgggcgtaaagcgtgcgtaggcggttattcaagtcagaggtgaaagcccggggctcaaccccggaacggcctttgaaactagataactagaatcttggagaggtcagtggaattccgagtgtagaggtgaaattcgtagatattcggaagaacaccagtggcgaaggcgactgactggacaagtattgacgctgaggtacgaaagcgtggggagcaaacaggattagataccctggtagtccacgccgtaaacgatgataactagctgtccggacacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctatccagagagatttggagttcccttcggggacgcggtgacaggtgctgcatggctgtcgtcagctcgtgtcgtgagatgttgggttaagtcccgcaacgagcgcaaccctcgtccttagttgccatcatttggttgggcactctaaggaaaccgccggtgataagccggaggaaggtggggatgacgtcaagtcctcatggcccttacacgctgggctacacacgtgctacaatggcggtgacagtgggcagcaagccagcgatggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaagga

SEQ ID NO: 6122 - DNA, 1489 bp, Novosphingobium sp. AAP93
  ref <308>: DATABASE ACCESSION NUMBER: NCBI ACCESSION: NZ_LJHZ01000126.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcatgcctaacacatgcaagtcgaacgagaccttcgggtctagtggcgcacgggtgcgtaacgcgtgggaatctgccctttgcttcggaataacagttagaaatgactgctaataccggatgatgtcttcggaccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagagtacgtaggcggctattcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtacgaaagcgtggggagcaaacaggattagataccctggtagtccacgccgtaaacgatgataactagttgttcggtcacttggtgactgagtgacgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacccagagagatttggggttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaaactcgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 6123 - DNA, 1497 bp, Novosphingobium sp. AP12
  ref <308>: DATABASE ACCESSION NUMBER: NCBI ACCESSION: NZ_AKKE01000064.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagtgagaaattactgctaataccggatgatgtcttcggaccaaagatttatcgcccagggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtaactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggattagagagatcttttccttcagttcggctggatgagtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacacgctgggctacacacgtgctacaatggcggtgacagtgggcagcaagcgcgcgagcgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaactcgcaagagaggcaggcgaccacagtgggtttagcgactggggtgaagtcgtaacaaggtagccgtaggggaacctgcggctggatcacctcctttctaagga

SEQ ID NO: 6124 - DNA, 1275 bp, Novosphingobium sp. B-7
  ref <308>: DATABASE ACCESSION NUMBER: NCBI ACCESSION: NZ_APCQ01000135.1
  ref <309>: DATABASE ENTRY DATE: 2019-04-01
  ref <313>: RELEVANT RESIDUES IN SEQ ID NO: (1)..(1275)
agttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtgactggaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccgcgctatatcgagagatcgatagttcccttcggggacgcggtgacaggtgctgcatggctgtcgtcagctcgtgtcgtgagatgttgggttaagtcccgcaacgagcgcaaccctcgtccttagttgccagcattaagttgggcactctaaggaaactgccggtgataagccggaggaaggtggggatgacgtcaagtcctcatggcccttacaggctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6125 - DNA, 1491 bp, Novosphingobium sp. B1
  ref <308>: DATABASE ACCESSION NUMBER: NCBI ACCESSION: NZ_FWXL01000004.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcgcgtaggcggcgacacaagtcagaggtgaaagcccggggctcaaccccggaactgcctttgaaactaggttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctattaccagagatggtaagttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 6126 - DNA, 1487 bp, Novosphingobium sp. B3058 49
  ref <308>: DATABASE ACCESSION NUMBER: NCBI ACCESSION: NZ_QKMM01000039.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcatgcctaacacatgcaagtcgaacgaacccttcggggttagtggcgcacgggtgcgtaacgcgtgggaatctgccccttgcttcggaataacagttagaaatgactgctaataccggatgatgacttcggtccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtgactggaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccgcgctatatcgagagatcgatagttcctttcggggacgcggtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacaggctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttcta

SEQ ID NO: 6127 - DNA, 1492 bp, Novosphingobium sp. CCH12-A3
  ref <308>: DATABASE ACCESSION NUMBER: NCBI ACCESSION: NZ_LSIA01000223.1
  ref <309>: DATABASE ENTRY DATE: 2019-04-01
  ref <313>: RELEVANT RESIDUES IN SEQ ID NO: (1)..(1492)
caacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggcgacacaagtcagaggtgaaagcccggggctcaaccccggaactgcctttgaaactaggttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctatcacaagagattgtgagttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 6128 - DNA, 1495 bp, Novosphingobium sp. Chol11
  ref <308>: DATABASE ACCESSION NUMBER: NCBI ACCESSION: NZ_OBMU01000007.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaatacatgcaagtcgaacgatctcttcggagatagtggcgcacgggtgcgtaacgcgtgggaatctgcccttgggttcggaataacatcgggaaactgatgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctagtatggtttccagagatggattccttcagttcggctggctaggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaag

SEQ ID NO: 6129 - DNA, 1471 bp, Novosphingobium sp. FSW06-99
  ref <308>: DATABASE ACCESSION NUMBER: NCBI ACCESSION: NZ_KQ954256.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcatgcctaacacatgcaagtcgaacgagatcttcggatctagtggcgcacgggtgcgtaacgcgtgggaatctgcccttgggttcggaataacagttagaaatgactgctaataccggatgaagtcttcggaccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggggcaaccctgatccagcaatgccgcgtgagtgatgaaggccttagggtcgtaaagctcttttacccgggatgataatgacagtaccgggagaataagccccggctaactccgtgccagcagccgcggtaatacggagggggctagcgttgttcggaattactgggcgtaaagcgcacgtaggcggttactcaagtcagaggtgaaagcccggggctcaaccccggaactgcctttgaaactaggtgactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctacgctacccagagagatttggggttcccttcggggacgtagagacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggataatccccaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6130 - DNA, 1297 bp, Novosphingobium sp. FSY-9
  ref <308>: DATABASE ACCESSION NUMBER: NCBI ACCESSION: NZ_SACO01000033.1
  ref <309>: DATABASE ENTRY DATE: 2019-04-01
  ref <313>: RELEVANT RESIDUES IN SEQ ID NO: (1)..(1297)
agggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtaactagaatcctggagaggtgagtggaattccgagtgtagaggtgaaattcgtagatattcggaagaacaccagtggcgaaggcggctcactggacaggtattgacgctgaggtgcgaaagcgtggggagcaaacaggattagataccctggtagtccacgccgtaaacgatgataactagctgtccgggttcatggaatttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctatccagagagatttggagttcccttcggggacgcggtgacaggtgctgcatggctgtcgtcagctcgtgtcgtgagatgttgggttaagtcccgcaacgagcgcaaccctcgtccttagttgccatcattaagttgggcactctaaggaaaccgccggtgataagccggaggaaggtggggatgacgtcaagtcctcatggcccttacacgctgggctacacacgtgctacaatggcggtgacagtgggcagcaaccttgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgtaagggaggcaggcgaccacagtgggtttagcgactggggtgaagtcgtaacaaggtagccgtaggggaacctgcggctggatcacctcctttcta

SEQ ID NO: 6131 - DNA, 1469 bp, Novosphingobium sp. Fuku2-ISO-50
  ref <308>: DATABASE ACCESSION NUMBER: NCBI ACCESSION: NZ_KQ954285.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcatgcctaacacatgcaagtcgaacgagatcttcggatctagtggcgcacgggtgcgtaacgcgtgggaatctgcccttgggttcggaataacagttagaaatgactgctaataccggatgaagtcttcggaccaaagatttatcgcccaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggtcgtaaagctcttttacccgggatgataatgacagtaccgggagaataagccccggctaactccgtgccagcagccgcggtaatacggagggggctagcgttgttcggaattactgggcgtaaagcgcacgtaggcggttactcaagtcagaggtgaaagcccggggctcaaccccggaactgcctttgaaactaggtgactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctacgctacccagagagatttggggttcccttcggggacgtagagacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggttaatcccaaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 6132 - DNA, 1495 bp, Novosphingobium sp. GV010
  ref <308>: DATABASE ACCESSION NUMBER: NCBI ACCESSION: NZ_QKMD01000005.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgagatccttcggggtctagtggcgcacgggtgcgtaacgcgtgggaatctgccccttgcttcggaataacagttagaaatgactgctaataccggatgatgacttcggtccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggtcagccaagtcagaggtgaaagcccggagctcaacttcggaactgcctttgaaactatctgactagaatcttggagaggcgggtggaattccgagtgtagaggtgaaattcgtagatattcggaagaacaccagtggcgaaggcggcccgctggacaagtattgacgctgaggtgcgaaagcgtggggagcaaacaggattagataccctggtagtccacgccgtaaacgatgataactagctgtccggacacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgtccttagttgccatcatttggttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaactcgcaagagaggcaggcgaccacagtgggtttagcgactggggtgaagtcgtaacaaggtagccgtaggggaacctgcggctggatcacctcctttctaag

SEQ ID NO: 6133 - DNA, 1487 bp, Novosphingobium sp. GV027
  ref <308>: DATABASE ACCESSION NUMBER: NCBI ACCESSION: NZ_QBUI01000040.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgacttcggtccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtgactggaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggcacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccgcgctatatcgagagatcgatagttcctttcggggacgcggtgacaggtgctgcatggctgtcgtcagctcgtgtcgtgagatgttgggttaagtcccgcaacgagcgcaaccctcgtccttagttgccagcattaagttgggcactctaaggaaactgccggtgataagccggaggaaggtggggatgacgtcaagtcctcatggcccttacaggctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttcta

SEQ ID NO: 6134 - DNA, 1487 bp, Novosphingobium sp. GV055; identical to SEQ ID NO: 6133
  ref <308>: DATABASE ACCESSION NUMBER: NCBI ACCESSION: NZ_QAOS01000040.1
  ref <309>: DATABASE ENTRY DATE: 2019-04-01
  ref <313>: RELEVANT RESIDUES IN SEQ ID NO: (1)..(1487)

SEQ ID NO: 6135 - DNA, 1487 bp, Novosphingobium sp. GV061; identical to SEQ ID NO: 6133
  ref <308>: DATABASE ACCESSION NUMBER: NCBI ACCESSION: NZ_QBUA01000040.1
  ref <309>: DATABASE ENTRY DATE: 2019-04-01
  ref <313>: RELEVANT RESIDUES IN SEQ ID NO: (1)..(1487)

SEQ ID NO: 6136 - DNA, 1487 bp, Novosphingobium sp. GV064; identical to SEQ ID NO: 6133
  ref <308>: DATABASE ACCESSION NUMBER: NCBI ACCESSION: NZ_PZZU01000040.1
  ref <309>: DATABASE ENTRY DATE: 2019-04-01
  ref <313>: RELEVANT RESIDUES IN SEQ ID NO: (1)..(1487)

SEQ ID NO: 6137 - DNA, 1487 bp, Novosphingobium sp. GV079; identical to SEQ ID NO: 6133
  ref <308>: DATABASE ACCESSION NUMBER: NCBI ACCESSION: NZ_QBUE01000040.1
  ref <309>: DATABASE ENTRY DATE: 2019-04-01
  ref <313>: RELEVANT RESIDUES IN SEQ ID NO: (1)..(1487)

SEQ ID NO: 6138 - DNA, 1493 bp, Novosphingobium sp. HII-3
  ref <308>: DATABASE ACCESSION NUMBER: NCBI ACCESSION: NZ_PPSM01000056.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagtgagaaattgctgctaataccggatgatgtcttcggaccaaagatttatcgcccagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggattagagagatcttttccttcagttcggctggatgagtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacacgctgggctacacacgtgctacaatggcggtgacagtgggcagcgagtgcgcgagcacaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaag

SEQ ID NO: 6139 - DNA, 1497 bp, Novosphingobium sp. KN65.2; identical to SEQ ID NO: 6113
  ref <308>: DATABASE ACCESSION NUMBER: NCBI ACCESSION: NZ_CCBH010000005.1
  ref <309>: DATABASE ENTRY DATE: 2019-04-01
  ref <313>: RELEVANT RESIDUES IN SEQ ID NO: (1)..(1497)

SEQ ID NO: 6140 - DNA, 1486 bp, Novosphingobium sp. LASN5T
  ref <308>: DATABASE ACCESSION NUMBER: NCBI ACCESSION: NZ_RQSI01000100.1
  ref <309>: DATABASE ENTRY DATE: 2019-04-01
  ref <313>: RELEVANT RESIDUES IN SEQ ID NO: (1)..(1486)
caacttgagagtttgatcctggctcagaacgaacgctggcggcatgcctaacacatgcaagtcgaacgaacccttcggggttagtggcgcacgggtgcgtaacgcgtgggaatctgccctttgcttcggaataactcagggaaacttgtgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccctcgggtcgtaaagctcttttaccagggatgataatgacagtacctggagaataagctccggctaactccgtgccagcagccgcggtaatacggagggagctagcgttgttcggaattactgggcgtaaagcgcacgtaggcggctactcaagtcagaggtgaaagcccggggctcaaccccggaactgcctttgaaactaggtggctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggtacttggtacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctaacccgagagatcgggtgttcccttcggggacgcggtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttcta

SEQ ID NO: 6141 - DNA, 1497 bp, Novosphingobium sp. Leaf2
  ref <308>: DATABASE ACCESSION NUMBER: NCBI ACCESSION: NZ_LMJY01000001.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagtgagaaattgctgctaataccggatgatgtcttcggaccaaagatttatcgcccagggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccagcaatggaggcaggcgaccacagtgggtttagcgactggggtgaagtcgtaacaaggtagccgtaggggaacctgcggctggatcacctcctttctaagga

SEQ ID NO: 6142 - DNA, 1486 bp, Novosphingobium sp. MD-1; identical to SEQ ID NO: 6140
  ref <308>: DATABASE ACCESSION NUMBER: NCBI ACCESSION: NZ_BBXA01000007.1
  ref <309>: DATABASE ENTRY DATE: 2019-04-01
  ref <313>: RELEVANT RESIDUES IN SEQ ID NO: (1)..(1486)

SEQ ID NO: 6143 - DNA, 1490 bp, Novosphingobium sp. NDB2Meth1
  ref <308>: DATABASE ACCESSION NUMBER: NCBI ACCESSION: NZ_FPEH01000035.1
  ref <309>: DATABASE ENTRY DATE: 2019-04-01
  ref <313>: RELEVANT RESIDUES IN SEQ ID NO: (1)..(1490)
aaacttgagagtttgatcctggctcagaacgaacgctggcggcatgcctaacacatgcaagtcgaacgagaccttcgggtctagtggcgcacgggtgcgtaacgcgtgggaatctgccctttgcttcggaataacagttagaaatgactgctaataccggatgatgtcttcggaccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagagtacgtaggcggctattcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtacgaaagcgtggggagcaaacaggattagataccctggtagtccacgccgtaaacgatgataactagttgttcggtcacttggtgactgagtgacgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacccagagagatttggggttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagcaaactcgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 6144 - DNA, 1497 bp, Novosphingobium sp. PP1Y
  ref <308>: DATABASE ACCESSION NUMBER: NCBI ACCESSION: NC_015580.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaatctgcccctcggttcggaataactcagggaaacttgagctaataccggataatgacttcggtccaaagatttattgccgagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcgtccttagttgccatcatttggttgggcactctaaggaaactgccggtgataagccggaggaaggtggggatgacgtcaagtcctcatggcccttacacgctgggctacacacgtgctacaatggcggtgacagtgggcagcgagtgcgcgagcacaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggtagtgcgctaaccggcaacggaggcagctaaccacggtgggatcagcgactggggtgaagtcgtaacaaggtagccgtaggggaacctgcggctggatcacctcctttctaagga

SEQ ID NO: 6145 - DNA, 1497 bp, Novosphingobium sp. Rr 2-17
  ref <308>: DATABASE ACCESSION NUMBER: NCBI ACCESSION: NZ_AKFJ01000034.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagatcttcggatctagtggcgcacgggtgcgtaacgcgtgggaatctgcccttgggttcggaataacagtgagaaattgctgctaataccggatgatgtcttcggaccaaagatttatcgcccaaggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacacgctgggctacacacgtgctacaatggcggtgacagtgagcagctaactcgcgagagtgtgctaatctctaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaactcgcaagagaggcaggcgaccacggtgggtttagcgactggggtgaagtcgtaacaaggtagccgtaggggaacctgcggctggatcacctcctttctaagga

SEQ ID NO: 6146 - DNA, 1455 bp, Novosphingobium sp. ST904
  ref <308>: DATABASE ACCESSION NUMBER: NCBI ACCESSION: NZ_LGJH01000052.1
  ref <309>: DATABASE ENTRY DATE: 2019-04-01
  ref <313>: RELEVANT RESIDUES IN SEQ ID NO: (1)..(1455)
gcatgcctaacacatgcaagtcgaacgagatcttcggatctagtggcgcacgggtgcgtaacgcgtgggaatctgcccttgggttcggaataacagtgagaaattactgctaataccggatgatgtcttcggaccaaagatttatcgcccagggatgagcccgcgtaggattagctagttggtggggtaatggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtaactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggtacttggtatttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggattagagagatcttttccttcagttcggctggatgagtgacaggtgctgcatggctgtcgtcagctcgtgtcgtgagatgttgggttaagtcccgcaacgagcgcaaccctcgtccttagttgccagcattcagttgggcactctaaggaaactgccggtgataagccggaggaaggtggggatgacgtcaagtcctcatggcccttacacgctgggctacacacgtgctacaatggcggtgacagtgggcagcaagcaggcgactgcaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaactcgcaagagaggcaggcgaccacagtgggtttagcgactggggtgaagtcgtaacaaggtagccgtaggggaacctgcggctggatcacctcctttctaagga

SEQ ID NO: 6147 - DNA, 1502 bp, Novosphingobium sp. SYSU G00007
  ref <308>: DATABASE ACCESSION NUMBER: NCBI ACCESSION: NZ_QGHL01000008.1
  ref <309>: DATABASE ENTRY DATE: 2019-04-01
  ref <313>: RELEVANT RESIDUES IN SEQ ID NO: (1)..(1502)
caacttgagagtttgatcctggctcagaacgaacgctggcggcatgcctaacacatgcaagtcgaacgagcccttcggggttagtggcgcacgggtgcgtaacgcgtgggaatctgccctttgcttcggaataacttcgggaaactgaagctaataccggatgatgtcctcattagagatattggggaccaaagatttatcggcaaaggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcgcgtaggcggctactcaagtcagaggtgaaagcccggggctcaaccccggaactgcctttgaaactaggtggctggaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgtctgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccgcgctatccagagagatttggagttcccttcggggacgcggtgacaggtgctgcatggctgtcgtcagctcgtgtcgtgagatgttgggttaagtcccgcaacgagcgcaaccctcgtccttagttgccatcattgagttgggcactctaaggaaaccgccggtgataagccggaggaaggtggggatgacgtcaagtcctcatggcccttacaggctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttcta

SEQ ID NO: 6148 - DNA, 1487 bp, Novosphingobium sp. TH158
  ref <308>: DATABASE ACCESSION NUMBER: NCBI ACCESSION: NZ_PKRT01000001.1
  ref <309>: DATABASE ENTRY DATE: 2019-04-01
  ref <313>: RELEVANT RESIDUES IN SEQ ID NO: (1)..(1487)
caaacttgagagtttgatcctggctcagaacgaacgctggcggcatgcctaacacatgcaagtcgaacgaaggcttcggccttagtggcgcacgggtgcgtaacgcgtgggaatctgcccctcggttcggaataacagttagaaatgactgctaataccggatgatgacttcggtccaaagatttatcgccgagggatgagcccgcgtaagattaggtagttggtagggtaaaggcctaccaagccgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctactcaagtcagaggtgaaagcccagggctcaaccctggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacttccagagatggaaggttcccttcggggacgcggtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacacgctgggctacacacgtgctacaatggcggtgacagtgggcagccacctcgcgagagggagctaatcccaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttcta

SEQ ID NO: 6149 - DNA, 1492 bp, Novosphingobium subterraneum; identical to SEQ ID NO: 6127
  ref <308>: DATABASE ACCESSION NUMBER: NCBI ACCESSION: NZ_BCZF01000083.1
  ref <309>: DATABASE ENTRY DATE: 2019-04-01
  ref <313>: RELEVANT RESIDUES IN SEQ ID NO: (1)..(1492)

SEQ ID NO: 6150 - DNA, 1489 bp, Novosphingobium tardaugens
  ref <308>: DATABASE ACCESSION NUMBER: NCBI ACCESSION: NZ_CP034179.1
  ref <309>: DATABASE ENTRY DATE: 2019-04-01
  ref <313>: RELEVANT RESIDUES IN SEQ ID NO: (1)..(1489)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagttagaaatgactgctaataccggatgatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatttaagtcaggggtgaaatcccggggctcaaccccggaactgcctttgaaactggatagctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatggagtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctaacccaagagattgggtgttcccttcggggacgcggtgacaggtgctgcatggctgtcgtcagctcgtgtcgtgagatgttgggttaagtcccgcaacgagcgcaaccctcgtccttagttgccatcattaagttgggcactctaaggaaaccgccggtgataagccggaggaaggtggggatgacgtcaagtcctcatggcccttacacgctgggctacacacgtgctacaatggcggtgacagtgggcagcaacctcgcgaggggtagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttcta

SEQ ID NO: 6151 - DNA, 1573 bp, Numidum massiliense
  ref <308>: DATABASE ACCESSION NUMBER: NCBI ACCESSION: NZ_CTDZ01000009.1
  ref <309>: DATABASE ENTRY DATE: 2019-04-01
  ref <313>: RELEVANT RESIDUES IN SEQ ID NO: (1)..(1573)
ttttatggagagtttgatcctggctcaggacgaacgctggcggcgtgcctaatacatgcaagtcgcgcggggtgaagcagccgaagccttcgggtggacgcagcggaacctagcggcgaacgggtgagtaacacgtgggtaacctgcccgagagacggggataacgtcgggaaaccggcgctaataccggatcacgacagacggtcgcatgaccgactgtccaaaggtggcgcaagctaccgctctcggatgggcccgcggcgcattagttagttggtgaggtaacggctcaccaaggcgacgatgcgtagccgacctgagagggtgatcggccacactgggactgagacacggcccagactcctacgggaggcagcagtagggaattttcggcaatgggggaaaccctgaccgagcaacgccgcgtgagcgaggacagccttcgggttgtaaagctctgtcatgtgggaagaatggcttgaggagtcactgccttaagcgtgacggtaccacaggaggaagccccggctaactacgtgccagcagccgcggtaatacgtagggggcgagcgttgtccggatttattgggcgtaaagcgcgcgcaggcggtctcttaagtctgatgtgaaaggccacggctcaaccgtgggatggcattggaaactgggggacttgagtgcaggagaggagagcggaattcccggtgtagcggtgaaatgcgtagagatcgggaggaacaccagtggcgaaggcggctctctggcctgcaactgacgctgaggcgcgaaagcgtgggtagcgaacaggattagataccctggtagtccacgccgtaaacgatgagtgctaggtgttaggggtttcaatacccttagtgccgaagttaacacattaagcactccgcctggggagtacggccgcaaggctgaaactcaaaggaattgacgggggcccgcacaagcggtggagcatgtggtttaattcgaagctacgcgaagaaccttaccagggcttgacatcctctgctagctctagagatagagtgttcccttcggggacagagtgacaggtggtgcatggttgtcgtcagctcgtgtcgtgagatgttgggttaagtcccgcaacgagcgcaacccttaagcttagttgccagcattgagttgggcactctaagttgactgccggtgacaaaccggaggaaggtggggatgacgtcaaatcatcatgccccttatgtcctgggcaacacacgtgctacaatggccggtacaaagggtagcgaagcggtgacgcggagccaatcccataaagccggtctcagttcggatcgcaggctgcaacccgcctgcgtgaagccggaatcgctagtaatcgcagatcagcatgctgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctacggag

SEQ ID NO: 6152 - DNA, 1509 bp, Occidentia massiliensis
  ref <308>: DATABASE ACCESSION NUMBER: NCBI ACCESSION: NZ_CANJ01000001.1
  ref <309>: DATABASE ENTRY DATE: 2019-04-01
  ref <313>: RELEVANT RESIDUES IN SEQ ID NO: (1)..(1509)
ttaaacttaagagtttgatcctggctcagaacgaacgctggcggcatgcttaacacatgcaagtcgaacgggttaaaatagacgtaagtttattttaattagtggcaaacgggtgagtaacacgtgggaatctgcccatcagtacgggataacttttagaaataaatgctaatactgtatattctctttggaggaaagatttatcgctgatggatgagcccgcggcagattaggtagttggtaaggtaatggcttaccaagccgacgatctgtagctggtctgagaggatgatcagccacactgggactgagatacggcccagactcctacgggaggcagcagtgaggaatattggacaatgggcgaaagcctgatccagcaatgccgcgtgagtgatgaaggccttagggttgtaaagctcttttagtagggatgataatgacagtacctacagaagaagccccggctaactctgtgccagcagccgcggtaagacagagggggctagcgttgttcggaattattgggcgtaaagagcgcgtaggcggtttaataagttagaagtgaaatcccgaagcttaacttcggaactgcttctaaaactattaagctagagtatggtagagggtgatggaattcctagtgtagaggtaaaattcttagatattaggaggaacaccagtggcgaaagctgtcacctgggccattactgacgctgaggcgcgaaagcatggggagcaaacaggattagataccctggtagtccatgctgtaaacgatgagtgctagacattggaaggcttttctttcagtttcgtagctaacgcattaagcactccgcctgggaagtacgatcgcaagattaaaactcaaaggaattgacgggggcccgcacaagcggtggagcatgcggtttaattcgatgttacgcgaaaaaccttaccaactcttgacatggtagtcgcgaatcgcggagacgcttttcttcagttcggctggactacacacaggtgttgcatggctgtcgtcagctcgtgtcgtgagatgttgggttaagtcccgcaacgagcgcaacccttattcttatttgccagcgggttatgccgggaactataagaaaactgccggtgctaagccggaggaaggtgaggatgatgtcaagtcatcatggcccttatgagttgggctacacgcgtgctacaatggtatctacagaaggatgcaatacggtgacgtggagcttaagccttaaaagatatctcagttcagattgtactctgcaactcgagtgcatgaagccggaatcgctagtaatcgcggatcagcatgccgcggtgaatacgttctcgggccttgtacacactgcccgtcacaccatgggagtcgggtttacctgaagttagtgagctaacgtaagaggcagctaaccacggtaggactgatgactggggtgaagtcgtaacaaggtagccgtaggtgaacctgcggctggattacctcctttaaag

SEQ ID NO: 6153 - DNA, 1508 bp, Oceanibacterium hippocampi
  ref <308>: DATABASE ACCESSION NUMBER: NCBI ACCESSION: NZ_FWFR01000014.1
  ref <309>: DATABASE ENTRY DATE: 2019-04-01
  ref <313>: RELEVANT RESIDUES IN SEQ ID NO: (1)..(1508)
tgaacttgagagtttgatcctggctcagaacgaacgctggcggcaggcctaacacatgcaagtcgaacgtgaagctaccttcgggtagtggaaagtggcgcacgggtgagtaacgcgtgggaatttgccccttggtacgggataacgccgggaaaccggcgctaataccgtataagctctacggaggaaagatttatcgccgagggatgagcccgcgtcggattaggtagttggtgaggtaacggctcaccaagccgacgatccgtagctggtttgagaggacgatcagccacactgggactgagacacggcccagactcctacgggaggcagcagtggggaatattggacaatgggggaaaccctgatccagccatgccgcgtgagtgaagaaggccttagggttgtaaagctctttcaccagggaagataatgacggtacctggagaagaagccccggctaactccgtgccagcagccgcggtaagacggagggggctagcgttgttcggaattactgggcgtaaagcgtgcgtaggcggcgtgccaagttggatgtgaaagcccagggctcaaccttggaattgcattcaaaactggcatgcttgagagcggaagaggtgagtggaactcccagtgtagaggtgaaattcgtagatattgggaagaacaccggtggcgaaggcggctcactggtccgtttctgacgctgaggcacgaaagcgtggggagcaaacaggattagataccctggtagtccacgccgtaaacgatgagtgctagatgttggggggcatgcccttcagtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggagtatgggtccgagagatcgggtccttcagttcggctggctcccgcacaggtgctgcatggctgtcgtcagctcgtgtcgtgagatgttgggttaagtcccgcaacgagcgcaacccctaccttcagttgccatcagttcggctgggcactctggagggactgccggtgataagccggaggaaggtggggatgacgtcaagtcctcatggcccttatgggctgggctacacacgtgctacaatggtggatacaatgggcagcgaaggggcgacccggggctaatcccaaaaatccatctcagttcggattgcactctgcaactcgagtgcatgaagtcggaatcgctagtaatcgcggaacagcatgccgcggtgaatacgttcccgggccttgtacacaccgcccgtcacaccatgggagttggctctacccgaaggcggtacgctaacctcgcaagaggaggcagccgaccacggtagggttagcgactggggtgaagtcgtaacaaggtagccgtaggggaacctgcggctggatcacctcctttctagga

SEQ ID NO: 6154 - DNA, 1494 bp, Oceanibaculum indicum
  ref <308>: DATABASE ACCESSION NUMBER: NCBI ACCESSION: NZ_RBIG01000002.1
  ref <309>: DATABASE ENTRY DATE: 2019-04-01
  ref <313>: RELEVANT RESIDUES IN SEQ ID NO: (1)..(1494)
gaacttgagagtttgatcctggctcagaacgaacgctggcggcatgcttaacacatgcaagtcgaacgatctcttcggagatagtggcggacgggtgagtaacgcgtgggaacctgccccgaggtacggaataactcatggaaacgtgagctaataccgtatgtgacctgagggtgaaagatttatcgccttgggaggggcccgcgtcggattaggtagttggtggggtaatggcctaccaagcctgcgatccgtagctggtctgagaggatgatcagccacactggaacttagacacggtccagactcctacgggaggcagcagtggggaatattggacaatgggggcaaccctgatccagcaatgccgcgtgcgtgatgaaggccttagggttgtaaagcgctttcggcggggaagatgatgacggtacccgcagaagaagccccggctaactccgtgccagcagccgcggtaatacggagggggctagcgttgttcggaattactgggcgtaaagggcgcgtaggcggcgatttaagttaggcgtgaaagccccgggcttaacctgggaactgcgcttgatactggattgcttgaggacgggagagggtagtggaattcccagtgtagaggtgaaattcgtagatattgggaagaacaccagtggcgaaggcgactgcctggcccgttactgacgctgaggcgcgaaagcgtggggagcaaacaggattagataccctggtagtccacgccgtaaacgatgagtgctagacgttggggaacatggtttctcggtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggagtttgggtcctggagacaggatccttcagttcggctggctcccgcacaggtgctgcatggctgtcgtcagctcgtgtcgtgagatgttgggttaagtcccgcaacgagcgcaacccccatctttagttgccatcggttcggccgggcactctagagaaactgccggtgacaagccggaggaaggcggggatgacgtcaagtcctcatggcccttatgggctgggctacacacgtgctacaatggcggtgacagagggcagcgagagggcgacctcaagctaatccctaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaagg

SEQ ID NO: 6155 - DNA, 1495 bp, Oceanibaculum nanhaiense
  ref <308>: DATABASE ACCESSION NUMBER: NCBI ACCESSION: NZ_MPOB01000022.1
  ref <309>: DATABASE ENTRY DATE: 2019-04-01
  ref <313>: RELEVANT RESIDUES IN SEQ ID NO: (1)..(1495)
tgaacttgagagtttgatcctggctcagaacgaacgctggcggcatgcttaacacatgcaagtcgaacgatctcttcggagatagtggcggacgggtgagtaacgcgtgggaacctgccccgaggtacggaataactcatggaaacgtgagctaataccgtatgtgacctgagggtgaaagatttatcgccttgggaggggcccgcgtcggattaggtagttggtggggtaatggcctaccaagcctgcgatccgtagctggtctgagaggatgatcagccacactggaacttagacacggtccagactcctacgggaggcagcagtggggaatattggacaatgggggcaaccctgatccagcaatgccgcgtgcgtgatgaaggccttagggttgtaaagcgctttcggcggggaagatgatgacggtacccgcagaagaagccccggctaactccgtgccagcagccgcggtaatacggagggggctagcgttgttcggaattactgggcgtaaagggcgcgtaggcggcgatttaagttaggcgtgaaagccccgggcttaacctgggaactgcgcttgatactggattgcttgaggacggaagagggtagtggaattcccagtgtagaggtgaaattcgtagatattgggaagaacaccagtggcgaaggcgactacctggtccgtttctgacgctgaggcgcgaaagcgtggggagcaaacaggattagataccctggtagtccacgccgtaaacgatgagtgctagacgttggggaacatggtttctcggtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggagtttggtttccggagacggagaccttcagttcggctggctcccgcacaggtgctgcatggctgtcgtcagctcgtgtcgtgagatgttgggttaagtcccgcaacgagcgcaaccctcatctttagttgccatcagttcggctgggcactctagagaaactgccggtgacaagccggaggaaggcggggatgacgtcaagtcctcatggcccttatgggctgggctacacacgtgctacaatggcggtgacagagggcagcaagggggcgacctcaagctaatccctaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaagg

SEQ ID NO: 6156 - DNA, 1497 bp, Oceanibaculum pacificum
  ref <308>: DATABASE ACCESSION NUMBER: NCBI ACCESSION: NZ_LPXN01000088.1
  ref <309>: DATABASE ENTRY DATE: 2019-04-01
  ref <313>: RELEVANT RESIDUES IN SEQ ID NO: (1)..(1497)
aacttgagagtttgatcctggctcagaacgaacgctggcggcatgcctaacacatgcaagtcgaacgatctcttcggagatagtggcggacgggtgagtaacgcgtgggaacctgccccgaggtacggaataactcatggaaacgtgagctaataccgtatgtgacctgagggtgaaagatttatcgccttgggaggggcccgcgtcggattaggtagttggtgaggtaacggctcaccaagcctgcgatccgtagctggtctgagaggatgatcagccacactggaacttagacacggtccagactcctacgggaggcagcagtggggaatattggacaatgggggcaaccctgatccagcaatgccgcgtgcgtgatgaaggccttagggttgtaaagcgctttcggcggggaagatgatgacggtacccgcagaagaagccccggctaactccgtgccagcagccgcggtaatacggagggggctagcgttgttcggaattactgggcgtaaagggcgcgtaggcggcgatttaagttaggcgtgaaagccccgggctcaacctgggaactgcgcttgatactggattgcttgaggacgggagagggtagtggaattcccagtgtagaggtgaaattcgtagatattgggaagaacaccagtggcgaaggcgactgcctggcccgttactgacgctgaggcgcgaaagcgtggggagcaaacaggattagataccctggtagtccacgccgtaaacgatgagtgctagacgttggggaacttagttcttcggtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggagtttgggtcttggagacaggatccttcagttcggctggctcccgcacaggtgctgcatggctgtcgtcagctcgtgtcgtgagatgttgggttaagtcccgcaacgagcgcaacccccatctttagttgccatcagttcggctgggcactctagagaaactgccggtgacaagccggaggaaggcggggatgacgtcaagtcctcatggcccttatgggctgggctacacacgtgctacaatggcggtgacaatgggcagcgaaggggcgaccctgtgctaatcccaaaaagccgtctcagttcggattgtactctgcaactcgagtgcatgaaggtggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaaggaagc

SEQ ID NO: 6157 - DNA, 1470 bp, Oceanicaulis alexandrii
  ref <308>: DATABASE ACCESSION NUMBER: NCBI ACCESSION: NZ_ATUP01000002.1
  ref <309>: DATABASE ENTRY DATE: 2019-04-01
  ref <313>: RELEVANT RESIDUES IN SEQ ID NO: (1)..(1470)
caacctgagagtttgattctggctcagaacgaacgctggcggaaggcttaacacatgcaagtcgagcgcacccttcggggtgagcggcagacgggtgagtaacgcgtgggaacgtgccctttggttcggaatagcccttggaaacgaggagtaatgccgaatgtgcccttcgggggaaagatttatcgccaaaggatcggcccgcgttagattagcttgttggtgaggtaacggctcaccaaggcgacgatctatagctggtctgagaggatgatcagccacactgggactgagacacggcccagactcctacgggaggcagcagtggggaatcttggacaatgggcgaaagcctgatccagccattccgcgtggatgatgaaggccctagggttgtaaaatcctttcggcagggaagataatgacggtacctgctaaagaagccccggctaactccgtgccagcagccgcggtaatacggagggggctagcgttgttcggaattactgggcgtaaagcgcacgtaggcggatcagtcagtcagaggtgaaatcccggagctcaacttcggaactgcctttgatactgctgatctagagtccgggagaggtgcatggaattccgagtgtagaggtgaaattcgtagatattcggaggaacaccagaggcgaaggcgatgcactggaccggtactgacgctgaggtgcgaaagcgtggggagcaaacaggattagataccctggtagtccacgccgtaaacgatgagagctagttgtctggcagcatgctgtcaggtgacgcagctaacgcattaagctctccgcctggggagtacggccgcaaggttaaaactcaaagaaattgacgggggcccgcacaagcggtggagcatgtggtttaattcgaagcaacgcgaagaaccttacctgcgcttgacatccctatcgcggattagagagatcttttccttcagctcggctggataggtgacaggtgctgcatggctgtcgtcagctcgtgtcgtgagatgttgggttaagtcccgcaacgagcgcaaccctcgccgttagttgccagcacgtttgggtgggcactctaacgggactgccggtgtcaaaccggaggaaggtggggatgacgtcaagtcatcatggcccttacgcgcagggctacacacgtgctacaatggcagtgacaatgagttaatctctaaaagctgtctcagttcgaattggggtctgcaactcgaccccatgaagtcggaatcgctagtaatcgtggatcagcatgccacggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttcta

SEQ ID NO: 6158 - DNA, 1471 bp, Oceanicaulis sp. HL-87
  ref <308>: DATABASE ACCESSION NUMBER: NCBI ACCESSION: NZ_JQMZ01000001.1
  ref <309>: DATABASE ENTRY DATE: 2019-04-01
  ref <313>: RELEVANT RESIDUES IN SEQ ID NO: (1)..(1471)
caacctgagagtttgattctggctcagaacgaacgctggcggaaggcttaacacatgcaagtcgagcgcacccttcggggtgagcggcagacgggtgagtaacgcgtgggaacgtgccctttggttcggaatagccccgggaaactgggagtaataccgaatgtgcccttcgggggaaagatttatcgccaaaggatcggcccgcgttagattagcttgttggtggggtaatggcccaccaaggcgacgatctatagctggtctgagaggatgatcagccacactgggactgagacacggcccagactcctacgggaggcagcagtggggaatcttggacaatgggcgaaagcctgatccagccattccgcgtggatgatgaaggccttagggttgtaaaatcctttcagcggggaagataatgactgtacccgcagaagaagccccggctaactccgtgccagcagccgcggtaatacggagggggctagcgttgttcggaattactgggcgtaaagcgcacgtaggcggatcagccagtcagaggtgaaagcccagggctcaaccttggaattgcctttgatactgttgatctggagtccgggagaggtgtgtggaattccgagtgtagaggtgaaattcgtagatattcggaggaacaccagaggcgaaggcgacacactggaccggtactgacgctgaggtgcgaaagcgtggggagcaaacaggattagataccctggtagtccacgccgtaaacgatggatgctagttgtcgggcagcatgctgttcggtgacgcagctaacgcattaagcatcccgcctggggagtacggccgcaaggttaaaactcaaagaaattgacgggggcccgcacaagcggtggagcatgtggtttaattcgaagcaacgcgcagaaccttacctgcccttgacatcccggtcgcggttttcagagatgaattccttcagttcggctggaccggtgacaggtgctgcatggctgtcgtcagctcgtgtcgtgagatgttgggttaagtcccgcaacgagcgcaaccctcgtcgttagttgccatcaggttgggctgggcactctagcgagactgccggtgtcaaaccggaggaaggtggggatgacgtcaagtcctcatggcccttacgggcagggctacacacgtgctacaatggcagtgacagagagttaatctctaaaagctgtctcagttcggattgttctctgcaactcgagagcatgaagttggaatcgctagtaatcgcggatcagcatgccgcggtgaatacgttcccgggccttgtacacaccgcccgtcacaccatgggagttggttctacccgaagatggtgcgctaaccgcaagggagcagccagccacggtagggtcagcgactggggtgaagtcgtaacaaggtagccgtaggggaacctgcggctggatcacctcctttctaa

SEQ ID NO: 6159 - DNA, 1471 bp, Oceanicaulis sp. HTCC2633
  ref <308>: DATABASE ACCESSION NUMBER: NCBI ACCESSION: NZ_CH672428.1
  ref <309>: DATABASE ENTRY DATE: 2019-04-01
  ref <313>: RELEVANT RESIDUES IN SEQ ID NO: (1)..(1471)
caacctgagagtttgattctggctcagaacgaacgctggcggaaggcttaacacatgcaagtcgagcgcgcccttcggggtgagcggcagacgggtgagtaacgcgtgggaacgtgccctttggttcggaatagcccttggaaacgaggagtaatgccgaatgtgcccttcgggggaaagatttatcgccaaaggatcggcccgcgttagattagctagttggtgaggtaatggctcaccaaggcgacgatctatagctggtctgagaggatgatcagccacactgggactgagacacggcccagactcctacgggaggcagcagtggggaatcttggacaatgggcgcaagcctgatccagccattccgcgtggatgatgaaggccctagggttgtaaaatcctttcggcagggaagataatgacggtacctgctaaagaagccccggctaactccgtgccagcagccgcggtaatacggagggggctagcgttgttcggaattactgggcgtaaagcgcgcgtaggcggatcgatcagtcagaggtgaaatcccggagctcaacttcggaactgcctttgatactgtcgatctggagtccgggagaggtgcatggaattccgagtgtagaggtgaaattcgtagatattcggaggaacaccagaggcgaaggcgatgcactggaccggtactgacgctgaggtgcgaaagcgtggggagcaaacaggattagataccctggtagtccacgccgtaaacgatgagagctagttgtcaggcagcatgctgtctggtgacgcagctaacgcattaagctctccgcctggggagtacggccgcaaggttaaaactcaaagaaattgacgggggcccgcacaagcggtggagcatgtggtttaattcgaagcaacgcgaagaaccttacctgcgcttgacatccctatcgcggattagagagatcttttccttcagttcggctggataggtgacaggtgctgcatggctgtcgtcagctcgtgtcgtgagatgttgggttaagtcccgcaacgagcgcaaccctcgccgttagttgccagcacgtttgggtgggcactctaacgggactgccggtgtcaaaccggaggaaggtggggatgacgtcaagtcatcatggcccttacgcgcagggctacacacgtgctacaatggcggtgacagtgagttaatctctaaaaaccgtctcagttcgaattggggtctgcaactcgaccccatgaagtcggaatcgctagtaatcgtggatcagcatgccacggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 6160 - DNA, 1471 bp, Oceanicaulis sp. PT13A
  ref <308>: DATABASE ACCESSION NUMBER: NCBI ACCESSION: NZ_PZZV01000001.1
  ref <309>: DATABASE ENTRY DATE: 2019-04-01
  ref <313>: RELEVANT RESIDUES IN SEQ ID NO: (1)..(1471)
caacctgagagtttgattctggctcagaacgaacgctggcggaaggcttaacacatgcaagtcgagcgcactcttcggagtgagcggcagacgggtgagtaacgcgtgggaacgtgccctttggttcggaatagcccttggaaacgaggagtaatgccgaatgtgcccttcgggggaaagatttatcgccaaaggatcggcccgcgttagattagctagttggtgaggtaacggctcaccaaggcgacgatctatagctggtctgagaggatgatcagccacactgggactgagacacggcccagactcctacgggaggcagcagtggggaatcttggacaatgggcgcaagcctgatccagccattccgcgtggatgatgaaggccctagggttgtaaaatcctttcggcagggaagataatgacggtacctgctaaagaagccccggctaactccgtgccagcagccgcggtaatacggagggggctagcgttgttcggaattactgggcgtaaagcgcacgtaggcggatcagtcagtcagaggtgaaatcccggagctcaacttcggaactgcctttgatactgctgatctagagtccgggagaggtgcatggaattccgagtgtagaggtgaaattcgtagatattcggaggaacaccagaggcgaaggcgatgcactggaccggtactgacgctgaggtgcgaaagcgtggggagcaaacaggattagataccctggtagtccacgccgtaaacgatgagagctagttgtctggcagcatgctgtcaggtgacgcagctaacgcattaagctctccgcctggggagtacggccgcaaggttaaaactcaaagaaattgacgggggcccgcacaagcggtggagcatgtggtttaattcgaagcaacgcgaagaaccttacctgcgcttgacatccctatcgcggattagagagatcttttccttcagttcggctggataggtgacaggtgctgcatggctgtcgtcagctcgtgtcgtgagatgttgggttaagtcccgcaacgagcgcaaccctcgccgttagttgccagcacgtttgggtgggcactctaacgggactgccggtgtcaaaccggaggaaggtggggatgacgtcaagtcatcatggcccttacgcgcagggctacacacgtgctacaatggcagtgacaatgagttaatctctaaaagctgtctcagttcgaattggggtctgcaactcgaccccatgaagtcggaatcgctagtaatcgtggatcagcatgccacggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 6161 - DNA, 1155 bp, Oceanicella actignis
  ref <308>: DATABASE ACCESSION NUMBER: NCBI ACCESSION: NZ_FRDL01000033.1
  ref <309>: DATABASE ENTRY DATE: 2019-04-01
  ref <313>: RELEVANT RESIDUES IN SEQ ID NO: (1)..(1155)
ggcagcagtggggaatcttggacaatgggcgcaagcctgatccagccatgccgcgtgagcgatgaaggccttagggttgtaaagctctttcagcggggacgataatgacggtacccgcagaagaagccccggctaactccgtgccagcagccgcggtaatacggagggggctagcgttgttcggaattactgggcgtaaagcgcacgtaggcggaccagtcagtcaggggtgaaatcccggggctcaaccccggaactgcctttgatactgctggtctggaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcggcttgccgttcggtgtcgcagctaacgcattaagcattccgcctggggagtacggccgcaaggttaaaactcaaaggaattgacgggggcccgcacaagcggtggagcatgtggtttaattcgaagcaacgcgcagaaccttaccatcccttgacatccccaacgcgggcctgcgagagcgggcccttcagttcggctggttgggtgacaggtgctgcatggctgtcgtcagctcgtgtcgtgagatgttgggttaagtcccgcaacgagcgcaaccctcgccttcagttgccagcattcggttgggcactctgaaggaaccgccggtgataagccggaggaaggtggggatgacgtcaagtcctcatggcccttacgggatgggctacacacgtgctacaatggcggtgacaatgggttaatccccaaaagccgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaacctcgcaagaggaggcagccggccacggtaagctcagcgactggggtgaagtcgtaacaaggtagccgtaggggaacctgcggctggatcacctcctttcta

SEQ ID NO: 6162 - DNA, 1469 bp, Oceanicella sp. SM1341
  ref <308>: DATABASE ACCESSION NUMBER: NCBI ACCESSION: NZ_QRGC01000062.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgccctcttcggagggagcggcggacgggtgagtaacgcgtgggaacgtgccctttgctgcggaatataccagggaaacttggggcaataccgcatacgcccttcgggggaaagatttatcggcgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcggaagcctgatctagccatgccgcgtgagcgatgaaggccttagggttgtaaagctctttcagcggggacgataatgacggtacccgcagaagaagccccggctaactccgtgccagcagccgcggtaatacggagggggctagcgttgttcggaattactgggcgtaaagcgcgcgtaggcggaccagtcagtcagaggtgaaatcccggggctcaacctcggaactgcctttgatactgctggtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggagcatgctcttcggtgtcgcagctaacgcattaagcattccgcctggggagtacggtcgcaagattaaaactcaaaggaattgacgggggcccgcacaagcggtggagcatgtggtttaattcgaagcaacgcgcagaaccttaccatcccttgacatcctcaacgcgatttcccgagagggatttcttcagttcggctggttgagtgacaggtgctgcatggctgtcgtcagctcgtgtcgtgagatgttgggttaagtcccgcaacgagcgcaaccctcgcctttagttgccagcattcagttgggcactctagaggaaccgccggtgataagccggaggaaggtggggatgacgtcaagtcctcatggcccttacgggatgggctacacacgtgctacaatggcagtgacaatgggttaatccccaaaagctgtctcagttcggattggtgcctgcaactcggcgccatgaagttggaatcgctagtaatcgcgtaacagcatgacgcggtgaatacgttcccgggccttgtacacaccgcccgtcacaccatgggaattggttctacccgaagatggtgcgccaaccgcaagggggcagccagccacggtaggatcagtgactggggtgaagtcgtaacaaggtagccgtaggggaacctgcggctggatcacctcctttctaa

SEQ ID NO: 6163 - DNA, 1467 bp, Oceanicola granulosus
  ref <308>: DATABASE ACCESSION NUMBER: NCBI ACCESSION: NZ_CH724109.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgagaccttcgggtctagcggcggacgggtgagtaacgcgtgggaatatgcccttcactgcggaatagccactggaaacggtgagtaataccgcatacgcccttcgggggaaagatttatcggtgaaggattagcccgcgtctgattaggtagttggtggggtaatggcctaccaagcctacgatcagtagctggtttgagaggatgatcagccacactgggactgagacacggcccagactcctacgggaggcagcagtggggaatcttagacaatgggcgcaagcctgatctagccatgccgcgtgagtgatgaaggccctagggtcgtaaagctctttcgctggggaagataatgactgtacccagtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgtgaccgctggagagatccagtttcccttcggggcacggtgacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggtagtgacaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaacctgttcgcagggggcagctggccacggtaagctcagcgactggggtgaagtcgtaacaaggtagccgtaggggaacctgcggctggatcacctcctttctaa

SEQ ID NO: 6164 - DNA, 1470 bp, Oceanicola litoreus
  ref <308>: DATABASE ACCESSION NUMBER: NCBI ACCESSION: NZ_FSRL01000001.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggtgagtaacgcgtgggaacgtacccttctctaaggaatagccactggaaacggtgagtaataccttatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggaaaccctgatctagccatgccgcgtgagtgacgaaggccctagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacacccttagttgccagcagttcggctgggcactctaagggaactgcccgtgataagcgggaggaaggtgtggatgacgtcaagtcctcatggcccttacgggttgggctacacacgtgctacaatggcagtgacaatgggttaatccccaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgaagacggtgcgccaacctgcaaaggaggcagccggccacggtgagctcagcgactggggtgaagtcgtaacaaggtagccgtaggggaacctgcggctggatcacctcctttctaa

SEQ ID NO: 6165 - DNA, 1470 bp, Oceanicola sp. HL-35
  ref <308>: DATABASE ACCESSION NUMBER: NCBI ACCESSION: NZ_JAFT01000005.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcttaacacatgcaagtcgagcgagaccttcgggtctagcggcggacgggttagtaacgcgtgggaacgtgcccttcactacggaatagtcccgggaaactgggtttaataccgtatacgcccttcgggggaaagaatttcggtgaaggatcggcccgcgtctgattagatagttggtggggtaatggcctaccaagtctacgatcagtagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgcctgtgatgataatgacagtagcaggtaaagaaaccccggctaactccgtgccagcagccgcggtaatacggagggggttagcgttgttcggaattactgggcgtaaagcgcgcgtaggcggactattaagtcagaggtgaaatcccggggctcaaccccggaacggcctttgatactggtagtcttgagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctctgaccgcctgggagaccaggttttctcgcaagagacagagtgacaggtgctgcatggctgtcgtcagctcgtgtcgtgagatgttcggttaagtccggcaacgagcgcaacccacgtccttagttgccagcagttcggctgggcactctaaggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacctcttcggaggaggcaggcggccacggtaggatcagcgactggggtgaagtcgtaacaaggtagccgtaggggaacctgcggctggatcacctcctttctaa

SEQ ID NO: 6166 - DNA, 1471 bp, Oceanicola sp. MCTG156 1a
  ref <308>: DATABASE ACCESSION NUMBER: NCBI ACCESSION: NZ_JQMY01000001.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcttaacacatgcaagtcgagcgaagacttcggtcttagcggcggacgggtgagtaacgcgtgggaacgtgcccttctctacggaacagtcccgggaaactgggtttaataccgtatacgcccttcgggggaaagaatttcggagagggatcggcccgcgttagattaggtagttggtggggtaacggcctaccaagccgacgatctatagctggtttgagaggatgatcagccacactgggactgagacacggcccagactcctacgggaggcagcagtgaggaatcttggacaatgggggaaaccctgatccagccatgccgcgtgagtgatgaaggccctagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttgtcgcggttaccagagatggtttccttcagttcggctggacaagtgacaggtgctgcatggctgtcgtcagctcgtgtcgtgagatgttcggttaagtccggcaacgagcgcaacccacgttcttagttgccagcagttcggctgggcactctaagaaaactgccgatgataagtcggaggaaggtgtggatgacgtcaagtcctcatggcccttacgggttgggctacacacgtgctacaatggtaatgacaatgggttaatccccaaaagttatctcagttcggattgtcctctgcaactcgagggcatgaagtcggaatcgctagtaatcgcgtaacagcatgacgcggtgaatacgttcccgggccttgtacacaccgcccgtcacaccatgggagttggttctacccgacggccgtgcgctaacctttcgagggggcagcggaccacggtaggatcagcgactggggtgaagtcgtaacaaggtagccgtaggggaacctgcggctggatcacctcctttctaa

SEQ ID NO: 6167 - DNA, 1467 bp, Oceanicola sp. S124
  ref <308>: DATABASE ACCESSION NUMBER: NCBI ACCESSION: NZ_AFPM01000004.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcccttcggggtgagcggcggacgggtgagtaacgcgtgggaatatgcccttctctgcggaatagcctcgggaaactgagagtaataccgcatacgcccttcgggggaaagatttatcggagaaggattagcccgcgttggattagatagttggtggggtaatggcctaccaagtcgacgatccatagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcatctacagtgggttaatcccaaaaagatgtctcagttcggattgtcgtctgcaactcgacggcatgaagtcggaatcgctagtaatcgcgtaacagcatgacgcggtgaatacgttcccgggccttgtacacaccgcccgtcacatcatgggagttgggtttacccgaagacggtgcgccaaccttttggaggcagccggccacggtaggctcagcgactgggatgaagtcgtaacaaggtagccgtaggggaacctgcggctggatcacctcctttctaa

SEQ ID NO: 6168 - DNA, 1466 bp, Oceaniglobus indicus
  ref <308>: DATABASE ACCESSION NUMBER: NCBI ACCESSION: NZ_NMZM01000021.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgctccacttcggtggggagcggcggacgggtgagtaacgcgtgggaatatacccttctctacggaatagtctcgggaaactgggggtaataccgtatacgcccttcgggggaaagatttatcggagttggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagtgacgaaggccctagggtcgtaaagctctttcgctggggaagataatgactgtacccagtaaagaagtcccggctaactccgtgccagcagccgcggtaatacggaggggactagcgttgttcggaattactgggcgtaaagcgcacgtaggcggatcagcaagttaggggtgaaatcccggggctcaaccccggaactgcccttaaaactgttggtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggaaggaccgccggagagatccggttttctcgtaagagaccttcacacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttccacctgacgacgctgcgctaacccttcggggaggcaggcggccacggtgagatcagcgactggggtgaagtcgtaacaaggtagccgtaggggaacctgcggctggatcacctccttt

SEQ ID NO: 6169 - DNA, 1474 bp, Oceaniglobus sp. YLY08
  ref <308>: DATABASE ACCESSION NUMBER: NCBI ACCESSION: NZ_QAGK01000026.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgcacccttcggggtgagcggcggacgggtgagtaacgcgtgggaatatgcccttctctatggaatagtctcgggaaactgggggtaataccatatacgcccttcgggggaaagatttatcggagaaggattagcccgcgttggattaggtagttggtggggtaatggctcaccaagccgacgatccatagctggtttgagaggatgatcagccacactgggactgagacacggcccagactcctacgggaggcagcagtggggaatcttagacaatgggcgcaagcctgatctagccatgccgcgtgagtgacgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgcacgtaggcggattagcaagttaggggtgaaatcccggggctcaaccccggaactgcccttaaaactgttagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgtagttaccagagatggtttcgtcagttcggctggatatcatacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtccacctgaaggccgtgcgccaacctcgcaagagggggcagcggaccacggtgagctcagcgactggggtgaagtcgtaacaaggtagccgtaggggaacctgcggctggatcacctcctttctaa

SEQ ID NO: 6170 - DNA, 1472 bp, Oceaniovalibus guishaninsula
  ref <308>: DATABASE ACCESSION NUMBER: NCBI ACCESSION: NZ_AMGO01000012.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcacgcctaatacatgcaagtcgagcgctcacttcggtgggagcggcggacgggtgagtaacgcgtgggaacgtacccttctctacggaatagtctcgggaaactgggggtaataccgtatacgcccttcgggggaaagatttatcggagttggatcggcccgcgttagattagatagttggtggggtaatggcctaccaagtctacgatctatagctggtttgagaggatgatcagccacactgggactgagacacggcccagactcctacgggaggcagcagtagggaatcttagacaatgggcgaaagcctgatctagcgatgccgcgtgtgtgacgaaggccctagggtcgtaaagcactttcgctggggaagataatgactgtacccagtaaagaagtcccggctaactccgtgccagcagccgcggtaatacggaggggactagcgttgttcggaattactgggcgtaaagcgcacgtaggcggaccagcaagttaggggtgaaatcccggggctcaaccccggaactgcccttaaaactgttggtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacctgtcgtagttaccagagatggtttcgtcagttcggctggacaggatacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggtggtgacagtgggttaatccccaaaagccatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtccacccgaaggccgtgcgccaacctgcttgcaggaggcagcggaccacggtgagctcagcgactggggtgaagtcgtaacaaggtagccgtaggggaacctgcggctggatcacctcctttctaa

SEQ ID NO: 6171 - DNA, 1535 bp, Oceanivirga salmonicida
  ref <308>: DATABASE ACCESSION NUMBER: NCBI ACCESSION: NZ_LOQI01000092.1
  ref <309>: DATABASE ENTRY DATE: 2019-04-01
  ref <313>: RELEVANT RESIDUES IN SEQ ID NO: (1)..(1535)
aacaagattgaatgaagagtttgatcctggctcaggataaacgctgacagaatgcttaacacatgcaagtcgatgatgagtataatagcttgctattatacaagtcatggcggacgggtgagtaacgcgtaaagaacttaccctctagactggaataacagggagaaatttctgataaaactagataagttagtaataggcatctattacaaatgaaacactatatgtgctagaggagagctttgcgtcctattagctagttggtaaggtaaaggcttaccaaggcgatgataggtagccggcctgagagggtggacggccacaaggggactgagatacggcccttactcctacgggaggcagcagtggggaatattggacaatggaggaaactctgatccagcaattctgtgtgcacgaagacggttttaggattgtaaagtgcttttagttgggaagaaagaaatgacggtaccaacagaagaagcgacggctaaatacgtgccagcagccgcggtaatacgtatgtcgcaagcgttatccggaattattgggcttaaagggcatctaggcggtataacaagttgaaggtgaaaagctgtggctcaaccatagtcttgcctacaaaactgtaatactagagtgctggaaaggtgggtggaactacacgagtagaggtgaaattcgtagatatgtgtaggaatgccgatgatgaagataactcactggacagcaactgacgctgaagtgcgaaagctaggggagcaaacaggattagataccctggtagtcctagctgtaaacgatgatcactgggtgtgggggttcgaagcctctgtgccgaagcaaaagcgataagtgatccgcctggggagtacgttcgcaagaatgaaactcaaaggaattgacgggggcccgcacaagtggtggagcatgtggtttaattcgacgctacgcgaggaaccttaccagatcttgacatccacggaatatttaagagattaagtagtgccttcgggaaccgtgagacaggtggtgcatggctgtcgacagctcgtgttgtgagatgttgggttaagtcccgcaacgagcgaaacccctatcattagttaccatcattaagttggggactctaatgaaactgcctgcgaagagcaggaggaaggtggggatgacgtcaagtcatcatgccccttatgatctgggctacacacgtgctacaatgggtagtacaaagagaagctaggtggcgacactaagcaaatctagaaagctactcttagttcggattggagtctgcaactcgactccatgaagttggaatcactagtaatcgtgaatcagcaatgtcacggtgaatacgttctcgggccttgtacacaccgcccgtcacaccacgagagttgtttgcacctgaagttactggcctaactcgaaagagagggaagtacctaaggtgtgaatagtgattggggtgaagtcgtaacaaggtatccgtaccggaaggtgcggatggatcacctcctttctaagga

SEQ ID NO: 6172 - DNA, 293 bp, Oceanobacillus damuensis
  ref <308>: DATABASE ACCESSION NUMBER: NCBI ACCESSION: NZ_LQNF01000021.1
  ref <309>: DATABASE ENTRY DATE: 2019-04-01
  ref <313>: RELEVANT RESIDUES IN SEQ ID NO: (1)..(293)
tttatggagagtttgatcttggctcaggacgaacgctggcggcgtgcctaatacatgcaagtcgagcgcgggaagcttaactgaacccttcggggtgaagaagagtggaacgagcggcggacgggtgagtaacacgtgggcaacctgcctgtaagattgggataactcgcggaaacgtgagctaataccgaataatactttttgtctcctgacagaaagatgaaaggcggcttttggctgtcacttacagatgggcccgcggcgcattagctagttggtgaggtaacggctca

SEQ ID NO: 6173 - DNA, 922 bp, Oceanobacillus iheyensis
  ref <308>: DATABASE ACCESSION NUMBER: NCBI ACCESSION: NZ_LT727775.1
  ref <309>: DATABASE ENTRY DATE: 2019-04-01
  ref <313>: RELEVANT RESIDUES IN SEQ ID NO: (1)..(922)
gaatgagcggcggacgggtgagtaacacgtaggcaacctgcctgtaagactgggataactcgtggaaacgcgagctaataccggataacacttttcatctcctgatgagaagttgaaaggcggcttttgctgtcacttacagatgggcctgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccatagtaactgatggcaccttgacggtacctaaccagaaagccacggctaactacgtgccagcagccgcggtaatacgtaggtggcaagcgttgtccggaattattgggcgtaaagcgctcgcaggcggttctttaagtctgatgtgaaatcttacggctcaaccgtaaacgtgcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaac

SEQ ID NO: 6174 - DNA, 1566 bp, Oceanobacillus jeddahense
  ref <308>: DATABASE ACCESSION NUMBER: NCBI ACCESSION: NZ_CCDM010000008.1
  ref <309>: DATABASE ENTRY DATE: 2019-04-01
  ref <313>: RELEVANT RESIDUES IN SEQ ID NO: (1)..(1566)
tttatggagagtttgatcttggctcaggacgaacgctggcggcgtgcctaatacatgcaagtcgagcgcgggaagcgaacagaactcttcggagggacgttcgtggaacgagcggcggacgggtgagtaacacgtaggcaacctgcctgtaagactgggataactcgcggaaacgcgagctaatacctgataatacttagcatcacctgatgataagttaaaaggcggcttttgctgtcacttacagatgggcctgcggcgcattagctagttggtggggtaagggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcggggaagaacaagtacgatagtaactgatcgtaccttgacggtacccgaccagaaagccacggctaactacgtgccagcagccgcggtaatacgtaggtggcaagcgttgtccggaattattgggcgtaaagcgctcgcaggcggttctttaagtctgatgtgaaatcttgcagctcaactgcaaacgtgcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttgaccgctctagagatagagttttcccttcggggacaaagtgacaggtggtgcatggttgtcgtcagctcgtgtcgtgagatgttgggttaagtcccgcaacgagcgcaacccttaatcttagttgccagcatttagttgggcactctaaggtgactgccggtgacaaaccggaggaaggtggggatgacgtcaaatcatcatgccccttatgacctgggctacacacgtgctacaatggacggaacaaagggaagcgaatccgcgaggtgaagcaaatcccataaaaccgttctcagttcggattgtaggctgcaactcgcctacatgaagccggaatcgctagtaatcgcggatcagcatgccgcggtgaatacgttcccgggtcttgtacacaccgcccgtcacaccacgagagttcgtaacacccgaagtcggtgaggtaaccttttggagccagccgccgaaggtgggacgaatgattggggtgaagtcgtaacaaggtagccgtatcggaaggtgcggctggatcacctcctttctaa

SEQ ID NO: 6175 - DNA, 1570 bp, Oceanobacillus kimchii
  ref <308>: DATABASE ACCESSION NUMBER: NCBI ACCESSION: NZ_CM001792.1
  ref <309>: DATABASE ENTRY DATE: 2019-04-01
  ref <313>: RELEVANT RESIDUES IN SEQ ID NO: (1)..(1570)
tttatggagagtttgatcttggctcaggacgaacgctggcggcgtgcctaatacatgcaagtcgagcgcaggaagttatctgatcctcttttagaggtgacgataatggaatgagcggcggacgggtgagtaacacgtaggcaacctgcctgtaagactgggataactcgtggaaacgcgagctaataccggataacacttttcatctcctgatgagaagttgaaaggcggcttttgctgtcacttacagatgggcctgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccatagtaactgatggcaccttgacggtacctaaccagaaagccacggctaactacgtgccagcagccgcggtaatacgtaggtggcaagcgttgtccggaattattgggcgtaaagcgctcgcaggcggttctttaagtctgatgtgaaatcttacggctcaaccgtaaacgtgcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaacactctagagatagagttttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggacgacgtcaaatcatcatgccccttatgacctgggctacacacgtgctacaatggatggaacaaagggaagcgaacccgcgaggtcaagcaaatcccacaaaaccattctcagttcggattgtaggctgcaacctcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctggatcacctcctttctaa

SEQ ID NO: 6176 - DNA, 1569 bp, Oceanobacillus manasiensis
  ref <308>: DATABASE ACCESSION NUMBER: NCBI ACCESSION: NZ_CCDL010000001.1
  ref <309>: DATABASE ENTRY DATE: 2019-04-01
  ref <313>: RELEVANT RESIDUES IN SEQ ID NO: (1)..(1569)
ttttttggagagtttgatcttggctcaggacgaacgctggcggcgtgcctaatacatgcaagtcgagcgcaggaagcaagcagatccccttcgggggtgacgcttgtggaatgagcggcggacgggtgagtaacacgtgggcaacctgcctgtaagactgggataaccccgggaaaccggggctaataccggataatacttttctttgcataaaggaaagttgaaaggcggtttcggctgccacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtcgggtagtaactgacccggccttgacggtacctaaccagaaagccccggctaactacgtgccagcagccgcggtaatacgtagggggcaagcgttgtccggaattattgggcgtaaagcgctcgcaggcggtcctttaagtctgatgtgaaatctcgcggctcaaccgcgaacggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgctattcctagagataggaagttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggaagcaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 6177 - DNA, 1367 bp, Oceanobacillus massiliensis
  ref <308>: DATABASE ACCESSION NUMBER: NCBI ACCESSION: NZ_CAER01000083.1
  ref <309>: DATABASE ENTRY DATE: 2019-04-01
  ref <313>: RELEVANT RESIDUES IN SEQ ID NO: (1)..(1367)
gtctcctggcaagaagatgaaaggcggcttttagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgcgagagtaactgctcgcaccttgacggtacctgaccagaaagccacggctaactacgtgccagcagccgcggtaatacgtaggtggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccaccctagagatagggatttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggaagcgaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctggatcacctcctttctaa

SEQ ID NO: 6178 - DNA, 1566 bp, Oceanobacillus oncorhynchi
  ref <308>: DATABASE ACCESSION NUMBER: NCBI ACCESSION: NZ_CDGG01000001.1
  ref <309>: DATABASE ENTRY DATE: 2019-04-01
  ref <313>: RELEVANT RESIDUES IN SEQ ID NO: (1)..(1566)
tttatggagagtttgatcttggctcaggacgaacgctggcggcgtgcctaatacatgcaagtcgagcgcgggaagcgaacggaactcttcggagggaagttcgtggaacgagcggcggacgggtgagtaacacgtaggcaacctgcctgtaagactgggataactcgcggaaacgcgagctaataccggataacactttctatcacctgatggaaagttgaaaggcggcttttgctgtcacttacagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtacgatagtaactgatcgtaccttgacggtacctgaccagaaagccacggctaactacgtgccagcagccgcggtaatacgtaggtggcaagcgttgtccggaattattgggcgtaaagcgctcgcaggcggttctttaagtctgatgtgaaatcttgcggctcaaccgcaaacgtgcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttgaccgctctagagatagagttttcccttcggggacaaagtgacaggtggtgcatggttgtcgtcagctcgtgtcgtgagatgttgggttaagtcccgcaacgagcgcaacccttaatcttagttgccagcatttagttgggcactctaaggtgactgccggtgacaaaccggaggaaggtggggatgacgtcaaatcatcatgccccttatgacctgggctacacacgtgctacaatggacggaacaaagggaagcgaacccgcgaggtccagcaaatcccataaaaccgttctcagttcggattgcaggctgcaactcgcctgcatgaagccggaatcgctagtaatcgcggatcagcatgccgcggtgaatacgttcccgggtcttgtacacaccgcccgtcacaccacgagagttcgtaacacccgaagtcggtgaggtaaccttttggagccagccgccgaaggtgggacgaatgattggggtgaagtcgtaacaaggtagccgtatcggaaggtgcggctggatcacctcctttctaa

SEQ ID NO: 6179 - DNA, 1571 bp, Oceanobacillus senegalensis
  ref <308>: DATABASE ACCESSION NUMBER: NCBI ACCESSION: NZ_LT839648.1
  ref <309>: DATABASE ENTRY DATE: 2019-04-01
  ref <313>: RELEVANT RESIDUES IN SEQ ID NO: (1)..(1571)
ttttttggagagtttgatcttggctcaggacgaacgctggcggcgtgcctaatacatgcaagtcgagcgcgggaagctaactgatcccccttcggggggtgacgttagtggaacgagcggcggacgggtgagtaacacgtgggcaacctgcctgtaagattgggataacttgcggaaacgtgagctaataccggataatacttttcatcgcatgatggagagtttgaaagacggcttcggctgtcacttacagatgggcccgcggcgcattagttagttggtgaggtaaaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtatgatagtaactgatcataccttgacggtacctaaccagaaagccacggctaactacgtgccagcagccgcggtaatacgtaggtggcaagcgttgtccggatttattgggcgtaaagcgctcgcaggcggtcttttaagtctgatgtgaaatcttgcggcttaaccgtgagcggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtgggtagcgaacaggattagataccctggtagtccacgccgtaaacgatgagtgctaggtgttagagggtttccgccctttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacactcctagagataggattttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggaagcgaaaccgtgaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 6180 - DNA, 1566 bp, Oceanobacillus sojae
  ref <308>: DATABASE ACCESSION NUMBER: NCBI ACCESSION: NZ_LT727813.1
  ref <309>: DATABASE ENTRY DATE: 2019-04-01
  ref <313>: RELEVANT RESIDUES IN SEQ ID NO: (1)..(1566)
tttatggagagtttgatcttggctcaggacgaacgctggcggcgtgcctaatacatgcaagtcgagcgcgggaagcggacagaactcttcggagggacgttcgtggaacgagcggcggacgggtgagtaacacgtaggcaacctgcctgtaagactgggataactcgcggaaacgcgagctaataccggataatacttatgatctcctgatgataagttgaaaggcggcttttgctgtcacttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcggggaagaacaagtatgatagtaactgatcgtaccttgacggtacccgaccagaaagccacggctaactacgtgccagcagccgcggtaatacgtaggtggcaagcgttgtccggaattattgggcgtaaagcgctcgcaggcggttctttaagtctgatgtgaaatcttgcggctcaaccgtaaacgtgcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttgaaccctctggagacagagctttcccttcggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggaacaaagggaagcaagcccgcgaggtcaagcaaatcccataaaaccgttctcagttcggattgtaggctgcaactcgcctacatgaagccggaatcgctagtaatcgcggatcagcatgccgcggtgaatacgttcccgggtcttgtacacaccgcccgtcacaccacgagagttcgtaacacccgaagtcggtgaggtaaccttttggagccagccgccgaaggtgggacgaatgattggggtgaagtcgtaacaaggtagccgtatcggaaggtgcggctggatcacctcctttctaa

SEQ ID NO: 6181 - DNA, 1503 bp, Oceanobacillus sp. Castelsardo
  ref <308>: DATABASE ACCESSION NUMBER: NCBI ACCESSION: NZ_LYCS01000008.1
  ref <309>: DATABASE ENTRY DATE: 2019-04-01
  ref <313>: RELEVANT RESIDUES IN SEQ ID NO: (1)..(1503)
tttttggagagtttgatcttggctcaggacgaacgctggcggcgtgcctaatacatgcaagtcgagcgctggaaactactttcaacccttcggggatgaaagtggtggaaagagcggcggacgggtgagtaacacgtgggcaacctacctgtaagactgggataactcgcggaaacgtgagctaataccggataatattttttattgcataataagaagtttaaaaggcggcgtaagctgtcacttacagatgggcccgcggcgcattagctagttggtggggtaaaggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtatgatagtaactgatcatgccttgacggtacctaaccagaaagccacggctaactacgtgccagcagccgcggtaatacgtaggtggcaagcgttgtccggatttattgggcgtaaagcgctcgcaggcggtcttttaagtctgatgtgaaagcccacggcttaaccgtggagggtcattggaaactggaggacttgagtgcagaagaggagagtggaattccatgtgtagcggtgaaatgcgtagagatatggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttcgacctccctagagatagggatttcccttcggggacgaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgtgaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggacc

SEQ ID NO: 6182 - DNA, 1554 bp, Oceanobacillus sp. E9
  ref <308>: DATABASE ACCESSION NUMBER: NCBI ACCESSION: NZ_LSNA01000007.1
  ref <309>: DATABASE ENTRY DATE: 2019-04-01
  ref <313>: RELEVANT RESIDUES IN SEQ ID NO: (1)..(1554)
aacttggctcaggacgaacgctggcggcgtgcctaatacatgcaagtcgagcgcaggaagttatctgatcctcttttagaggtgacgataatggaatgagcggcggacgggtgagtaacacgtaggcaacctgcctgtaagactgggataactcgtggaaacgcgagctaataccggataacacttttcatctcctgatgagaagttgaaaggcggcttttgctgtcacttacagatgggcctgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccatagtaactgatggcaccttgacggtacctaaccagaaagccacggctaactacgtgccagcagccgcggtaatacgtaggtggcaagcgttgtccggaattattgggcgtaaagcgctcgcaggcggttctttaagtctgatgtgaaatcttacggctcaaccgtaaacgtgcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaacactctagagatagagttttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggacgacgtcaaatcatcatgccccttatgacctgggctacacacgtgctacaatggatggaacaaagggaagcgaacccgcgaggtcaagcaaatcccacaaaaccattctcagttcggattgtaggctgcaactcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctggatcacctcctttctaa

SEQ ID NO: 6183 - DNA, 1569 bp, Oceanobacillus timonensis
  ref <308>: DATABASE ACCESSION NUMBER: NCBI ACCESSION: NZ_LT800497.1
  ref <309>: DATABASE ENTRY DATE: 2019-04-01
  ref <313>: RELEVANT RESIDUES IN SEQ ID NO: (1)..(1569)
ttttatggagagtttgatcttggctcaggacgaacgctggcggcgtgcctaatacatgcaagtcgagcgcgggaagcgaacggaactcttcggagggaagttcgtggaacgagcggcggacgggtgagtaacacgtaggcaacctgcctgtaagactgggataactcgcggaaacgcgagctaataccggataacacttcccatcacctgatgaggagttaaaagacggcttttgctgtcacttacagatgggcctgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcggggaagaacaagtacgatagtaactgatcgtaccttgacggtacccgaccagaaagccacggctaactacgtgccagcagccgcggtaatacgtaggtggcaagcgttgtccggaattattgggcgtaaagcgctcgcaggcggttttttaagtctgatgtgaaatcttgcagctcaactgcaaacgtgcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttgaccgctctagagatagagttttcccttcggggacaaagtgacaggtggtgcatggttgtcgtcagctcgtgtcgtgagatgttgggttaagtcccgcaacgagcgcaacccttaatcttagttgccagcatttagttgggcactctaaggtgactgccggtgacaaaccggaggaaggtggggatgacgtcaaatcatcatgccccttatgacctgggctacacacgtgctacaatggacggaacaaagggaagcgaagcggtgacgttttagcaaatcccagaaaaccgttctcagttcggattgcaggctgcaactcgcctgcatgaagccggaatcgctagtaatcgcggatcagcatgccgcggtgaatacgttcccgggtcttgtacacaccgcccgtcacaccacgagagttcgtaacacccgaagtcggtggggtaacctttttaagagccagccgccgaaggtgggacgaatgattggggtgaagtcgtaacaaggtagccgtatcggaaggtgcggctggatcacctcctttcta

SEQ ID NO: 6184 - DNA, 1085 bp, Oceanospirillales bacterium WDS2A16A
  ref <308>: DATABASE ACCESSION NUMBER: NCBI ACCESSION: NZ_QPEP01000025.1
  ref <309>: DATABASE ENTRY DATE: 2019-04-01
  ref <313>: RELEVANT RESIDUES IN SEQ ID NO: (1)..(1085)
tggttaatacccatcagccgtgacgttacctacagaagaagcaccggctaactccgtgccagcagccgcggtaatacggagggtgcgagcgttaatcggaattactgggcgtaaagcgtacgtaggctgttacttaagccagatgtgaaagccccgggctcaacctgggaactgcatttggaactgagtaactagaatgtgtgagaggcaagtggaatttccagtgtagcggtgaaatgcgtagagattggaaagaacaccagtggcgaaggcgacttgctggcataacattgacgctgaggtacgaaagcgtgggtagcaaacaggattagataccctggtagtccacgccgtaaacgatgtctactagttgttgggacctttatggacttagtgacgcagctaacgcattaagtagaccgcctggggagtacggtcgcaagattaaaactcaaatgaattgacgggggcccgcacaagcggtggagcatgtggtttaattcgatgcaacgcgaagaaccttacctagccttgacatccagagaatttggtagagataccttagtgccttcgggaactctgtgacaggtgctgcatggctgtcgtcagctcgtgttgtgaaatgttgggttaagtcccgtaacgagcgcaacccttatctttagttgccagcacttcgggtggggactctagagagactgccggtgacaaaccggaggaaggcggggacgacgtcaagtcatcatggcccttacggctagggctacacacgtgctacaatggcaaggacagagggcagcgaactcgcgagagtaagccaatcccagaaaccttgtcgtagtccggattggagtctgcaactcgactccatgaagtcggaatcgctagtaatcgcgaatcagaatgtcgcggtgaatacgttcccgggccttgtacacaccgcccgtcacaccacgggagttgattgcaccagaagtaggtagcctaacctttggagggcgcttaccacggtgtggtcgatgactggggtgaagtcgtaacaaggtagccctaggggaacctggggctggatcacctccttaaac

SEQ ID NO: 6185 - DNA, 1535 bp, Oceanotoga teriensis
  ref <308>: DATABASE ACCESSION NUMBER: NCBI ACCESSION: NZ_QGGI01000040.1
  ref <309>: DATABASE ENTRY DATE: 2019-04-01
  ref <313>: RELEVANT RESIDUES IN SEQ ID NO: (1)..(1535)
aggatgaagggtttgatcctggctcagggtgaacgctggcggcgcgcctaacacatgcaagtcgaacgaagaaagggtagcttgctacccgagtaagagtggcgaacgggtgagtaaagcgtaggaatctgcccaaaggaccgggataactgctggaaacggtagataagaccggataagcccgagaggggaaagtatcgagagatagccgaaggaggggcctacgtcccatcaggtagttggaagtgtaagagactcccaagccgacgacgggtagccgatgtgagagcatgatcggccacaagggcactgagacacgggtcctactcctacgggaggcagcagtggggaattttggacaatggacggaagtctgatccagcgacgccgcgtgaaggaagaagtccttcgggatgtaaacttctgaacttatcgaataaagacaactggggacagttggatgaaggtagataaagaaaagccccggctaactacgtgccagcagccgcggtaagacgtagggggcgagcgttgcccggaattactgggcgtaaagggggcgtaggcggtcaaataagtcagatgtgaaatactactgctcaacggtagaaatgcgtttgaaactgtaagacttgagggtaccaaaggtagacggaattacctgagtaggggtgaaatccgtagatacaggtaagaacgccagtggggaagccggtctactggggtaaccctgacgctgaggcccgaaagctaggggagcgaaccggattagatacccgggtagtcctagcagtaaacgatgctcactaggtgtggggagtgaattctccgtgctgaagcgaacgcgataagtgagccgcctggggagtacggccgcaaggctgaaactcaaaggaattgacgggggtccgcacaagcggtggagcatgtggtttaattcgaagctaaccgaagaaccttaccagggaatgacatggagataagggtatagagatatatccaagtattacttaggtgatacagtctcacacaggtggtgcacggccgtcgtcagctcgtgccgtgaggtgttgggttaagtcccacaacgagcgcaacccctaccattagttgccagcgagtaaagttgggctactctaatgggacagccgtcgacgagacggaggaaggaggggatgacgtcaggtaagcgtgccccttatgctctgggcgacacacgtgctacaatggtacgggcagagggcagcgaaactgcgaagtgaagcgaatctcataaaccgtgccgtaattcggattgtagtctgaaacccgactacatgaaaccggaatcgctagtaatcgcaggtcagccaaactgcggtgaatacgttcccggaccttgtacacaccgcccgtcacgccacccgagttggagacgcccgaaaatggtagacataaccgcaaggagtgaaactattaagggcgggatcagcgaggggggcgaagtcgtaacaaggtaggtgtaccggaaggtgcgcctggatcacctcctttct

SEQ ID NO: 6186 - DNA, 1491 bp, Ochrobactrum cytisi
  ref <308>: DATABASE ACCESSION NUMBER: NCBI ACCESSION: NZ_MOEC01000067.1
  ref <309>: DATABASE ENTRY DATE: 2019-04-01
  ref <313>: RELEVANT RESIDUES IN SEQ ID NO: (1)..(1491)
ttcaacttgagagtttgatcctggctcagaacgaacgctggcggcaggcttaacacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 6187 - DNA, 1490 bp, Ochrobactrum grignonense
tcaacttgagagtttgatcctggctcagaacgaacgctggcggcaggcttaacacatgcaagtcgagcgcccttttcggagggagcggcagacgggtgagtaacgcgtgggaatctaccttttgctacggaataactcagggaaacttgtgctaataccgtatgtgcccttcgggggaaagatttatcggcaaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgacggtcttaggattgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcgtgcgaacgcaagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgcaaggaggcaggtgaccacggtagggtcagcgactggggtgaagtcgtaacaaggtagccgtaggggaacctgcggctggatcacctcctttctaag

SEQ ID NO: 6188 - DNA, 1488 bp, Ochrobactrum grignonense
tcaacttgagagtttgatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgcccttttggggaaagatttatcggcaaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgacggtcttaggattgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcgtgcgaacgcaagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgcaaggaggcaggtgaccacggtagggtcagcgactggggtgaagtcgtaacaaggtagccgtaggggaacctgcggctggatcacctcctttctaag

SEQ ID NO: 6189 - DNA, 1489 bp, Ochrobactrum haematophilum
  ref <308>: DATABASE ACCESSION NUMBER: NCBI ACCESSION: NZ_OOFM01000004.1
  ref <309>: DATABASE ENTRY DATE: 2019-04-01
  ref <313>: RELEVANT RESIDUES IN SEQ ID NO: (1)..(1489)
tcaacttgagagtttgatcctggctcagaacgaacgctggcggcaggcttaacacatgcaagtcgagcgccccgcaaggggagcggcagacgggtgagtaacgcgtgggaatctaccatttgctacggaacaacagttggaaacgactgctaataccgtatgtgccctttgggggaaagatttatcggcaaatgatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaagaggcaggcgaccacggtagggtcagcgactggggtgaagtcgtaacaaggtagccgtaggggaacctgcggctggatcacctcctttctaag

SEQ ID NO: 6190 - DNA, 1493 bp, Ochrobactrum oryzae
  ref <308>: DATABASE ACCESSION NUMBER: NCBI ACCESSION: NZ_PTRC01000041.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgcccttttcggagggagcggcagacgggtgagtaacgcgtgggaatctacctatctctagggaataactcagggaaacttgtgctaataccctatacgtccttcgggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggattggtcagttaggggtgaaatcccagggctcaaccctggaactgcctttaatactgccagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagtttggctggatcggagacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6191 - DNA, 1532 bp, Ochrobactrum pituitosum
  ref <308>: DATABASE ACCESSION NUMBER: NCBI ACCESSION: NZ_PYSY02000001.1
  ref <309>: DATABASE ENTRY DATE: 2019-04-01
  ref <313>: RELEVANT RESIDUES IN SEQ ID NO: (1)..(1532)
tcaacttgagagtttgatcctggctcagaacgaacgctggcggcaggcttaacacatgcaagtcgagcgccccgcaaggggggagcggcagacgggtgagtaacgcgtgggaatctaccttttgctacggaacaacagttggaaacgactgctaataccgtatgtgcccccctttaaaatttcaggatacataaaatgccctggcattttatgggggggaaagatttatcggcaaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactggggtgaagtcgtaacaaggtagccgtaggggaacctgcggctggatcacctcctttctaag

SEQ ID NO: 6192 - DNA, 1488 bp, Ochrobactrum pseudogrignonense
  ref <308>: DATABASE ACCESSION NUMBER: NCBI ACCESSION: NZ_PCOK01000002.1
  ref <309>: DATABASE ENTRY DATE: 2019-04-01
  ref <313>: RELEVANT RESIDUES IN SEQ ID NO: (1)..(1488)
tcaacttgagagtttgatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgcccttcgggggaaagatttatcggcaaaggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactggggtgaagtcgtaacaaggtagccgtaggggaacctgcggctggatcacctcctttctaag

SEQ ID NO: 6193 - DNA, 1535 bp, Ochrobactrum sp. 23A 997 2015
  ref <308>: DATABASE ACCESSION NUMBER: NCBI ACCESSION: NZ_PCFM01000003.1
  ref <309>: DATABASE ENTRY DATE: 2019-04-01
  ref <313>: RELEVANT RESIDUES IN SEQ ID NO: (1)..(1535)
tcaacttgagagtttgatcctggctcagaacgaacgctggcggcaggcttaacacatgcaagtcgagcgggcccttcggggtcagcggcagacgggtgagtaacgcgtgggaacgtaccatttgctacggaataactcagggaaacttgtgctaataccgtatgagcccccctttaaaatttcaggaatcataaaatgccctggcattttatgggggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6194 - DNA, 1535 bp, Ochrobactrum sp. 27A 999 2015; identical to SEQ ID NO: 6193
  ref <308>: DATABASE ACCESSION NUMBER: NCBI ACCESSION: NZ_PCFL01000001.1
  ref <309>: DATABASE ENTRY DATE: 2019-04-01
  ref <313>: RELEVANT RESIDUES IN SEQ ID NO: (1)..(1535)

SEQ ID NO: 6195 - DNA, 1535 bp, Ochrobactrum sp. 30A 1000 2015; identical to SEQ ID NO: 6193
  ref <308>: DATABASE ACCESSION NUMBER: NCBI ACCESSION: NZ_PCFK01000008.1
  ref <309>: DATABASE ENTRY DATE: 2019-04-01
  ref <313>: RELEVANT RESIDUES IN SEQ ID NO: (1)..(1535)

SEQ ID NO: 6196 - DNA, 1491 bp, Ochrobactrum sp. 689 2009
  ref <308>: DATABASE ACCESSION NUMBER: NCBI ACCESSION: NZ_PCQU01000001.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgagcccttcgggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6197 - DNA, 1491 bp, Ochrobactrum sp. 695 2009; identical to SEQ ID NO: 6196
  ref <308>: DATABASE ACCESSION NUMBER: NCBI ACCESSION: NZ_PCQT01000002.1
  ref <309>: DATABASE ENTRY DATE: 2019-04-01
  ref <313>: RELEVANT RESIDUES IN SEQ ID NO: (1)..(1491)

SEQ ID NO: 6198 - DNA, 1491 bp, Ochrobactrum sp. 715 2009; identical to SEQ ID NO: 6196
  ref <308>: DATABASE ACCESSION NUMBER: NCBI ACCESSION: NZ_PCQS01000001.1
  ref <309>: DATABASE ENTRY DATE: 2019-04-01
  ref <313>: RELEVANT RESIDUES IN SEQ ID NO: (1)..(1491)

SEQ ID NO: 6199 - DNA, 1491 bp, Ochrobactrum sp. 720 2009; identical to SEQ ID NO: 6196
  ref <308>: DATABASE ACCESSION NUMBER: NCBI ACCESSION: NZ_PCQR01000001.1
  ref <309>: DATABASE ENTRY DATE: 2019-04-01
  ref <313>: RELEVANT RESIDUES IN SEQ ID NO: (1)..(1491)

SEQ ID NO: 6200 - DNA, 1491 bp, Ochrobactrum sp. 721 2009; identical to SEQ ID NO: 6196
  ref <308>: DATABASE ACCESSION NUMBER: NCBI ACCESSION: NZ_PCQQ01000005.1
  ref <309>: DATABASE ENTRY DATE: 2019-04-01
  ref <313>: RELEVANT RESIDUES IN SEQ ID NO: (1)..(1491)

SEQ ID NO: 6201 - DNA, 1491 bp, Ochrobactrum sp. AV
  ref <308>: DATABASE ACCESSION NUMBER: NCBI ACCESSION: NZ_SADZ01000016.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6202 - DNA, 1489 bp, Ochrobactrum sp. BO-7
  ref <308>: DATABASE ACCESSION NUMBER: NCBI ACCESSION: NZ_RCHH01000038.1
  ref <309>: DATABASE ENTRY DATE: 2019-04-01
  ref <313>: RELEVANT RESIDUES IN SEQ ID NO: (1)..(1489)
tcaacttgagagtttgatcctggctcagaacgaacgctggcggcaggcttaacacatgcaagtcgagcgccccgcaaggggagcggcagacgggtgagtaacgcgtgggaatctaccatttgctacggaacaacagttggaaacgactgctaataccgtatgtgccctaacggggaaagatttatcggcaaatgatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggactaataagtcaggggtgaaatcccggggctcaaccccggaactgcctttgatactgttagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6203 - DNA, 1474 bp, Ochrobactrum sp. CDB2
  ref <308>: DATABASE ACCESSION NUMBER: NCBI ACCESSION: NZ_AKVI01000058.1
  ref <309>: DATABASE ENTRY DATE: 2019-04-01
  ref <313>: RELEVANT RESIDUES IN SEQ ID NO: (1)..(1474)
gatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgcccttcgggggaaagatttatcggcaaaggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactggggtgaagtcgtaacaaggtagccgtaggggaacctgcggctggatcacctcctttctaagg

SEQ ID NO: 6204 - DNA, 1489 bp, Ochrobactrum sp. DDT2
  ref <308>: DATABASE ACCESSION NUMBER: NCBI ACCESSION: NZ_LKAD01000002.1
  ref <309>: DATABASE ENTRY DATE: 2019-04-01
  ref <313>: RELEVANT RESIDUES IN SEQ ID NO: (1)..(1489)
tcaacttgagagtttgatcctggctcagaacgaacgctggcggcaggcttaacacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6205 - DNA, 1493 bp, Ochrobactrum sp. EGD-AQ16
  ref <308>: DATABASE ACCESSION NUMBER: NCBI ACCESSION: NZ_AWEU01000033.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 6206 - DNA, 1489 bp, Ochrobactrum sp. MH181795; identical to SEQ ID NO: 6204
  ref <308>: DATABASE ACCESSION NUMBER: NCBI ACCESSION: NZ_RAPI01000008.1
  ref <309>: DATABASE ENTRY DATE: 2019-04-01
  ref <313>: RELEVANT RESIDUES IN SEQ ID NO: (1)..(1489)

SEQ ID NO: 6207 - DNA, 1488 bp, Ochrobactrum sp. MYb14
  ref <308>: DATABASE ACCESSION NUMBER: NCBI ACCESSION: NZ_PCOP01000017.1
  ref <309>: DATABASE ENTRY DATE: 2019-04-01
  ref <313>: RELEVANT RESIDUES IN SEQ ID NO: (1)..(1488)
tcaacttgagagtttgatcctggctcagaacgaacgctggcggcaggcttaacacatgcaagtcgagcgccccgcaaggggagcggcagacgggtgagtaacgcgtgggaatctaccttttgctacggaacaacagttggaaacgactgctaataccgtatgtgcccttcgggggaaagatttatcggcaaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactggggtgaagtcgtaacaaggtagccgtaggggaacctgcggctggatcacctcctttctaag

SEQ ID NO: 6208 - DNA, 1488 bp, Ochrobactrum sp. MYb15; identical to SEQ ID NO: 6207
  ref <308>: DATABASE ACCESSION NUMBER: NCBI ACCESSION: NZ_PCOO01000001.1
  ref <309>: DATABASE ENTRY DATE: 2019-04-01
  ref <313>: RELEVANT RESIDUES IN SEQ ID NO: (1)..(1488)

SEQ ID NO: 6209 - DNA, 1488 bp, Ochrobactrum sp. MYb18; identical to SEQ ID NO: 6207
  ref <308>: DATABASE ACCESSION NUMBER: NCBI ACCESSION: NZ_PCON01000019.1
  ref <309>: DATABASE ENTRY DATE: 2019-04-01
  ref <313>: RELEVANT RESIDUES IN SEQ ID NO: (1)..(1488)

SEQ ID NO: 6210 - DNA, 1488 bp, Ochrobactrum sp. MYb19; identical to SEQ ID NO: 6207
  ref <308>: DATABASE ACCESSION NUMBER: NCBI ACCESSION: NZ_PCOM01000017.1
  ref <309>: DATABASE ENTRY DATE: 2019-04-01
  ref <313>: RELEVANT RESIDUES IN SEQ ID NO: (1)..(1488)

SEQ ID NO: 6211 - DNA, 1488 bp, Ochrobactrum sp. MYb29; identical to SEQ ID NO: 6207
  ref <308>: DATABASE ACCESSION NUMBER: NCBI ACCESSION: NZ_PCOL01000050.1
  ref <309>: DATABASE ENTRY DATE: 2019-04-01
  ref <313>: RELEVANT RESIDUES IN SEQ ID NO: (1)..(1488)

SEQ ID NO: 6212 - DNA, 1489 bp, Ochrobactrum sp. MYb49; identical to SEQ ID NO: 6204
  ref <308>: DATABASE ACCESSION NUMBER: NCBI ACCESSION: NZ_PCOI01000001.1
  ref <309>: DATABASE ENTRY DATE: 2019-04-01
  ref <313>: RELEVANT RESIDUES IN SEQ ID NO: (1)..(1489)

SEQ ID NO: 6213 - DNA, 1488 bp, Ochrobactrum sp. MYb68; identical to SEQ ID NO: 6207
  ref <308>: DATABASE ACCESSION NUMBER: NCBI ACCESSION: NZ_PCOE01000033.1
  ref <309>: DATABASE ENTRY DATE: 2019-04-01
  ref <313>: RELEVANT RESIDUES IN SEQ ID NO: (1)..(1488)

SEQ ID NO: 6214 - DNA, 1490 bp, Ochrobactrum sp. MYb71
  ref <308>: DATABASE ACCESSION NUMBER: NCBI ACCESSION: NZ_PCOC01000001.1
  ref <309>: DATABASE ENTRY DATE: 2019-04-01
  ref <313>: RELEVANT RESIDUES IN SEQ ID NO: (1)..(1490)
tcaacttgagagtttgatcctggctcagaacgaacgctggcggcaggcttaacacatgcaagtcgaacggtctcttcggaggcagtggcagacgggtgagtaacgcgtgggaatctaccttttgctacggaacaacagttggaaacgactgctaataccgtatgtgtccttcgggagaaagatttatcggcaaaggatgagcccgcgttggattagctagttggtagggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccagtgataagctggaggaaggtggggatgacgtcaagtcctcatggcccttacgggctgggctacacacgtgctacaatggtggtgacagtgggcagcgagcgtgcgagcgcaagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcactgtgctaaccgcaaggaggcaggtgaccacggtagggtcagcgactggggtgaagtcgtaacaaggtagccgtaggggaacctgcggctggatcacctcctttctaag

SEQ ID NO: 6215 - DNA, 1491 bp, Ochrobactrum sp. P6BS-III
  ref <308>: DATABASE ACCESSION NUMBER: NCBI ACCESSION: NZ_MPPJ01000011.1
  ref <309>: DATABASE ENTRY DATE: 2019-04-01
  ref <313>: RELEVANT RESIDUES IN SEQ ID NO: (1)..(1491)
ttcaacttgagagtttgatcctggctcagaacgaacgctggcggcaggcttaacacatgcaagtcgagcgccccgcaaggggagcggcagacgggtgagtaacgcgtgggaatctaccatttgctacggaacaactccgggaaactggagctaataccgtatgtgcccttcgggggaaagatttatcggcaaatgatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 6216 - DNA, 1491 bp, Ochrobactrum sp. POC9
  ref <308>: DATABASE ACCESSION NUMBER: NCBI ACCESSION: NZ_QGST01000066.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccttttgctacggaataactcagggaaacttgtgctaataccgtatgtgcccgaaaggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 6217 - DNA, 1491 bp, Ochrobactrum sp. UNC390CL2Tsu3S39; identical to SEQ ID NO: 6186
  ref <308>: DATABASE ACCESSION NUMBER: NCBI ACCESSION: NZ_JOOD01000006.1
  ref <309>: DATABASE ENTRY DATE: 2019-04-01
  ref <313>: RELEVANT RESIDUES IN SEQ ID NO: (1)..(1491)

SEQ ID NO: 6218 - DNA, 1488 bp, Ochrobactrum thiophenivorans; identical to SEQ ID NO: 6207
  ref <308>: DATABASE ACCESSION NUMBER: NCBI ACCESSION: NZ_PCOR01000001.1
  ref <309>: DATABASE ENTRY DATE: 2019-04-01
  ref <313>: RELEVANT RESIDUES IN SEQ ID NO: (1)..(1488)

SEQ ID NO: 6219 - DNA, 1472 bp, Octadecabacter antarcticus
  ref <308>: DATABASE ACCESSION NUMBER: NCBI ACCESSION: NC_020911.1
  ref <309>: DATABASE ENTRY DATE: 2019-04-01
  ref <313>: RELEVANT RESIDUES IN SEQ ID NO: (1)..(1472)
tcaacttgagagtttgatcctggctcagaacgaacgctggcggcacgcctaacacatgcaagtcgagcgcaatccttcgggatcgagcggcggacgggttagtaacgcgtgggaacatacccttctctaaggaatagcctcgggaaactgagagtaataccttatacgcccttcgggggaaagatttatcggagaaggattggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgaaagcctgatctagcgatgccgcgtgtgtgacgaaggccttagggtcgtaaagcactttcgccaaggatgataatgacagtacttggtaaagaaaccccggctaactccgtgccagcagccgcggtaatacggagggggttagcgttgttcggaattactgggcgtaaagcgcacgtaggcggactaataagttagaggtgaaatcccagggctcaaccctggaactgcctttaatactgttagtcttgagttcgagagaggtaagtggaattccgagtgtagaggtgaaattcgtagatattcggaggaacaccagtggcgaaggcggcttactggctcgatactgacgctgaggtgcgaaagcgtggggagcaaacaggattagataccctggtagtccacgccgtaaacgatgaatgccagacgttggggggcttgcccttcagtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctatatccagagatggatagttcccttaggggacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacccttcggggaggcagcggaccacggtaggatcagcgactggggtgaagtcgtaacaaggtagccgtaggggaacctgcggctggatcacctcctttctaa

SEQ ID NO: 6220 - DNA, 1474 bp, Octadecabacter arcticus
  ref <308>: DATABASE ACCESSION NUMBER: NCBI ACCESSION: NC_020908.1
  ref <309>: DATABASE ENTRY DATE: 2019-04-01
  ref <313>: RELEVANT RESIDUES IN SEQ ID NO: (1)..(1474)
tcaacttgagagtttgatcctggctcagaacgaacgctggcggcacgcctaacacatgcaagtcgagcgcaatccttcgggatcgagcggcggacgggttagtaacgcgtgggaacatacccttctctaaggaatagcctcgggaaactgagagtaataccttatacgcccttcgggggaaagatttatcggagaaggattggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgaaagcctgatctagcgatgccgcgtgtgtgacgaaggccttagggtcgtaaagcactttcgccaaggatgataatgacagtacttggtaaagaaaccccggctaactccgtgccagcagccgcggtaatacggagggggttagcgttgttcggaattactgggcgtaaagcgcacgtaggcggactaatcagttagaggtgaaatcccagggctcaaccctggaactgcctttaatactgttagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgttggggggcttgcccttcagtgtcacacttaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctatatccagagatggatagttcccttaggggacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacctcttaggaggaggcagcggaccacggtaggatcagcgactggggtgaagtcgtaacaaggtagccgtaggggaacctgcggctggatcacctcctttctaa

SEQ ID NO: 6221 - DNA, 1472 bp, Octadecabacter temperatus
  ref <308>: DATABASE ACCESSION NUMBER: NCBI ACCESSION: NZ_FSRP01000002.1
  ref <309>: DATABASE ENTRY DATE: 2019-04-01
  ref <313>: RELEVANT RESIDUES IN SEQ ID NO: (1)..(1472)
tcaacttgagagtttgatcctggctcagaacgaacgctggcggcacgcctaacacatgcaagtcgagcgcagtccttcgggaccgagcggcggacgggttagtaacgcgtgggaacatacccttctctaaggaatagcctcgggaaactgagagtaataccttataagcccttcgggggaaagatttatcggtgaaggattggcccgcgtaagattagatagttggtggggtaatggcctaccaagtctacgatctttagctggtttgagaggatgatcagcaacactgggactgagacacggcccagactcctacgggaggcagcagtggggaatcttagacaatgggggaaaccctgatctagcgatgccgcgtgtgtgacgaaggccttagggtcgtaaagcactttcgccaaggatgataatgacagtacttggtaaagaaaccccggctaactccgtgccagcagccgcggtaatacggagggggttagcgttgttcggaattactgggcgtaaagcgcacgtaggcggatatttaagttagaggtgaaatcccagggctcaaccctggaactgcctttaatactggatgtcttgagttcgagagaggtaagtggaattccaagtgtagaggtgaaattcgtagatatttggaggaacaccagtggcgaaggcggcttactggctcgatactgacgctgaggtgcgaaagcgtggggagcaaacaggattagataccctggtagtccacgccgtaaacgatgaatgccagacgttggggggcttgcccttcagtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctactaccagagatggtacgttcccttcggggacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacctttcgaggaggcagcggaccacggtaggatcagcgactggggtgaagtcgtaacaaggtagccgtaggggaacctgcggctggatcacctcctttctaa

SEQ ID NO: 6222 - DNA, 1576 bp, Oenococcus kitaharae
  ref <308>: DATABASE ACCESSION NUMBER: NCBI ACCESSION: NZ_JSAG01000020.1
  ref <309>: DATABASE ENTRY DATE: 2019-04-01
  ref <313>: RELEVANT RESIDUES IN SEQ ID NO: (1)..(1576)
ttttaaaatgagagtttgatcctggctcaggatgaacgctggcggcgtgcctaatacatgcaagtcgtacgctagccgttaacctgatctcttcggagtgacggctgacaatgactagagtggcgaacgggtgagtaacacgtaagaaacctgccctttagtgggggataacatttggaaacagatgctaataccgcgtaacaactttgaactcatgttcttagtttaaaaggtccttttggatcgctaaaggatggtcttgcggcgtattagctagttggtagggtaatggcctaccaaggccatgatgcgtagccgagttgagagactggccggccacattgggactgagacactgcccaaactcctacgggaggctgcagtagggaattttccgcaatgcacgaaagtgtgacggagcgacgccgcgtgtgtgatgaaggctttcgggtcgtaaagcactgttgtaagggaagaatgaccggattcagagaaagtttccggcttgacggtaccttaccagaaagggatggctaaatacgtgccagcagccgcggtaatacgtatgtcccgagcgttatccggatttattgggcgtaaagcgagcgcagacggttgattaagtctgatgtgaaatcccggagcctaactccggaactgcattggaaactggtttacttgagtgcgatagaggcaagtggaactccatgtgtagcggtgaaatgcgtagatatgtggaagaacaccagtggcgaaggcggcttgctagatcgtaactgacgttgaggctcgaaagtatgggtagcaaacgggattagataccccggtagtccataccgtaaacgatgggtgctagttgttaagaggtttccgcctcctagtgacgtagctaacgcattaagcaccccgcctgaggagtacggccgcaaggctaaaacttaaaggaattgacggggacccgcacaagcggtggagcatgtggtttaattcgaagatacgcgaaaaaccttaccaggccttgacataccagtgaccgcttttgtaatgaaagcttttcttcggaacattggatacaggtggtgcatggtcgtcgtcagctcgtgtcgtgagatgttgggttaagtcccgcaacgagcgcaacccttgttattagttgccagcattcagttgggcactctaatgagactgccggtgataaaccggaggaaggtggggacgacgtcagatcatcatgccccttatggcctgggcaacacacgtgctacaatgggaagtacaacgagttgcgaaccggtgacggcaagctaatctcttaaaacttctctcagttcggactggagtctgcaactcgactccacgaaggcggaatcgctagtaatcgcgaatcagcatgtcgcggtgaatacgttcccgggtcttgtacacaccgcccgtcaaatcatgggagtcggaagtacccaaagtcgcttggctaacttttagaggccggtgcctaaggtaagatcgatgactgggattaagtcgtaacaaggtagccgtaggagaacctgcggctggatcacctcctttctaagga

SEQ ID NO: 6223 - DNA, 1572 bp, Oenococcus oeni
  ref <308>: DATABASE ACCESSION NUMBER: NCBI ACCESSION: NZ_QYTB01000020.1
  ref <309>: DATABASE ENTRY DATE: 2019-04-01
  ref <313>: RELEVANT RESIDUES IN SEQ ID NO: (1)..(1572)
ttaaattgagagtttgatcctggctcaggatgaacgctggtggcgtgcctaatacatgcaagtcgtacgctagccgctgaattgatccttcgggtgaagtgaggcaatgactagagtggcgaactggtgagtaacacgtaagaaacctgccctttagtgggggataacatttggaaacagatgctaataccgcgtaacaacagatcacacatgtgatctgtttgaaaggtccttttggatcgctagaggatggtcttgcggcgtattagcttgttggtagggtagaagcctaccaaggcaatgatgcgtagccgagttgagagactggccggccacattgggactgagacactgcccaaactcctacgggaggctgcagtagggaattttccgcaatgcacgaaagtgtgacggagcgacgccgcgtgtgtgatgaaggctttcgggtcgtaaagcactgttgtaagggaagaataactgaattcagagaaagttttcagcttgacggtaccttaccagaaagggatggctaaatacgtgccagcagccgcggtaatacgtatgtcccgagcgttatccggatttattgggcgtaaagcgagcgcagacggtttattaagtctgatgtgaaatcccgaggcccaacctcggaactgcattggaaactgatttacttgagtgcgatagaggcaagtggaactccatgtgtagcggtgaaatgcgtagatatgtggaagaacaccagtggcgaaagcggcttgctagatcgtaactgacgttgaggctcgaaagtatgggtagcaaacgggattagataccccggtagtccataccgtaaacgatgggtgctagttgttaagaggtttccgcctcctagtgacgtagcaaacgcattaagcaccccgcctgaggagtacggccgcaaggctaaaacttaaaggaattgacggggacccgcacaagcggtggagcatgtggtttaattcgaagatacgcgaaaaaccttaccaggtcttgacataccaatgatcgcttttgtaatgaaagcttttcttcggaacattggatacaggtggtgcatggtcgtcgtcagttcgtgtcgtgagatgttgggttaagtcccgcaacgagcgcaacccttgttattagttgccagcatttagttgggcactctaatgagactgccggtgataaaccggaggaaggtggggacgacgtcagatcatcatgccccttatgacctgggcaacacacgtgctacaatgggaagtacaacgagtcgcaaaccggcgacggtaagctaatctcttaaaacttctctcagttcggactggagtctgcaactcgactccacgaaggcggaatcgctagtaatcgcgaatcagcatgtcgcggtgaatacgttcccgggtcttgtacacaccgcccgtcaaatcatgggagtcggaagtacccaaagtcgcttggctaacttttagaggccggtgcctaaggtaaaatcgatgactgggattaagtcgtaacaaggtagccgtaggagaacctgcggctggatcacctcctttctaagga

SEQ ID NO: 6224 - DNA, 1573 bp, Oenococcus sicerae
  ref <308>: DATABASE ACCESSION NUMBER: NCBI ACCESSION: NZ_CP029684.1
  ref <309>: DATABASE ENTRY DATE: 2019-04-01
  ref <313>: RELEVANT RESIDUES IN SEQ ID NO: (1)..(1573)
taaaatgagagtttgatcctggctcaggatgaacgctggcggcgtgcctaatacatgcaagtcgtacgctagccgttaagttgatctcttcggagtgacgcctaactatgactagagtggcgaactggtgagtaacacgtaagaaacctgccctttagtgggggataacatttggaaacagatgctaataccgcgtaacaacgtctgacacatgtcggtcgtttgaaagattcttttgaatcgctagaggatggtcttgcggcgtattagctagttggtagggtaatggcctaccaaggcgatgatgcgtagccgagttgagagactgaccggccacattgggactgagacactgcccaaactcctacgggaggctgcagtagggaattttccgcaatgcacgaaagtgtgacggagcgacgccgcgtgtgtgatgaaggctttcgggtcgtaaagcactgttgtaagggaagaataaccagattcagagaaagcttctggcttgacggtaccttaccagaaagggatggctaaatacgtgccagcagccgcggtaatacgtatgtcccgagcgttatccggatttattgggcgtaaagcgagcgcagacggtttattaagtctgatgtgaaatcccggggcctaaccccggaactgcattggaaactggtttacttgagtgcgatagaggcaagtggaactccatgtgtagcggtgaaatgcgtagatatgtggaagaacaccagtggcgaaagcggcttgctagatcgtaactgacgttgaggctcgaaagtatgggtagcaaacgggattagataccccggtagtccataccgtaaacgatgggtgctagttgttaagaggtttccgcctcttagtgacgtagctaacgcattaagcaccccgcctgaggagtacggccgcaaggctaaaacttaaaggaattgacggggacccgcacaagcggtggagcatgtggtttaattcgaagatacgcgaaaaaccttaccaggtcttgacataccaatgatcgcttttgtaatgaaagcttttcttcggaacattggatacaggtggtgcatggtcgtcgtcagctcgtgtcgtgagatgttgggttaagtcccgcaacgagcgcaacccttgttattagttgccagcatttagttgggcactctaatgagactgccggtgataaaccggaggaaggtggggacgacgtcagatcatcatgccccttatgacctgggcaacacacgtgctacaatgggaagtacaacgagttgcgaaccggcgacggtaagctaatctcttaaaacttctctcagttcggactggagtctgcaactcgactccacgaaggcggaatcgctagtaatcgcgaatcagcatgtcgcggtgaatacgttcccgggtcttgtacacaccgcccgtcaaatcatgggagtcggaagtacccaaagtcgcttggctaacttttagaggccggtgcctaaggtaaaatcgatgactgggattaagtcgtaacaaggtagccgtaggagaacctgcggctggatcacctcctttctaagga

SEQ ID NO: 6225 - DNA, 1572 bp, Oenococcus sp. UCMA 16435
  ref <308>: DATABASE ACCESSION NUMBER: NCBI ACCESSION: NZ_CP030868.1
  ref <309>: DATABASE ENTRY DATE: 2019-04-01
  ref <313>: RELEVANT RESIDUES IN SEQ ID NO: (1)..(1572)
ttaaattgagagtttgatcctggctcaggatgaacgctggcggcgtgcctaatacatgcaagtcgtacgctagccgctgaattgatccttcgggtgaagtgaggcaatgactagagtggcgaactggtgagtaacacgtaagaaacctgccctttagtgggggataacatttggaaacagatgctaataccgcgtaacaacaaattacacatgtgatttgtttgaaaggtccttttggatcgctagaggatggtcttgcggcgtattagcttgttggtagggtagaagcctaccaaggcaatgatgcgtagccgagttgagagactggccggccacattgggactgagacactgcccaaactcctacgggaggctgcagtagggaattttccgcaatgcacgaaagtgtgacggagcgacgccgcgtgtgtgatgaaggctttcgggtcgtaaagcactgttgtaagggaagaataactggattcagagaaagttttcagcttgacggtaccttaccagaaagggatggctaaatacgtgccagcagccgcggtaatacgtatgtcccgagcgttatccggatttattgggcgtaaagcgagcgcagacggtttattaagtctgatgtgaaatcccgaggcctaacctcggaactgcattggaaactggtttacttgagtgcgatagaggcaagtggaacttcatgtgtagcggtgaaatgcgtagatatgtggaagaacaccagtggcgaaagcggcttgctagatcgtaactgacgttgaggctcgaaagtatgggtagcaaacgggattagataccccggtagtccataccgtaaacgatgggtgctagttgttaagaggtttccgcctcctagtgacgtagcaaacgcattaagcaccccgcctgaggagtacggccgcaaggctaaaacttaaaggaattgacggggacccgcacaagcggtggagcatgtggtttaattcgaagatacgcgaaaaaccttaccaggtcttgacataccaatgatcgcttttgtaatgaaagcttttcttcggaacattggatacaggtggtgcatggtcgtcgtcagctcgtgtcgtgagatgttgggttaagtcccgcaacgagcgcaacccttgttattagttgccagcatttagttgggcactctaatgagactgccggtgataaaccggaggaaggtggggacgacgtcagatcatcatgccccttatgacctgggcaacacacgtgctacaatgggaagtacaacgagtcgctaaccggtgacggcaagctaatctcttaaaacttctctcagttcggactggagtctgcaactcgactccacgaaggcggaatcgctagtaatcgcgaatcagcatgtcgcggtgaatacgttcccgggtcttgtacacaccgcccgtcaaatcatgggagtcggaagtacccaaagtcgcttggctaacttttagaggccggtgcctaaggtaaaatcgatgactgggattaagtcgtaacaaggtagccgtaggagaacctgcggctggatcacctcctttctaagga

SEQ ID NO: 6226 - DNA, 1528 bp, Oerskovia turbata
  ref <308>: DATABASE ACCESSION NUMBER: NCBI ACCESSION: NZ_SDJR01000018.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacggtgatgcccagcttgctgggtggatcagtggcgaacgggtgagtaacacgtgagtaacctgccccagactccgggataagccttggaaacgaggtctaatactggatacgagatgcccctgcatggggagtgtctggaaagatttatcggtctgggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcaaggctcaaccttgagcttgcatcgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcttatgttgccagcacgtcatggtggggactcataagagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagctgtcgaaggtgggactggcgattgggactaagtcgtaacaaggtagccgtaccggaaggtgcggctggatcacctcctttctaagga

SEQ ID NO: 6227 - DNA, 1528 bp, Oerskovia turbata
tttacggagagtttgatcctggctcaggacgaacgctggcggcgtgcttaacacatgcaagtcgaacggtgatggccagcttgctggtcggatcagtggcgaacgggtgagtaacacgtgagtaacctgccccagactctgggataagccttggaaacgaggtctaatactggatatgagatgcccctgcatggggagtgtctggaaagatttatcggtctgggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcaaggctcaaccttgagcttgcatcgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcttatgttgccagcacgtcatggtggggactcataagagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagctgtcgaaggtgggactggcgattgggactaagtcgtaacaaggtagccgtaccggaaggtgcggctggatcacctcctttctaagga

SEQ ID NO: 6228 - DNA, 1526 bp, Ohtaekwangia koreensis
  ref <308>: DATABASE ACCESSION NUMBER: NCBI ACCESSION: NZ_FUZU01000005.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcttaatacatgcaagtcgaacggtaagtgtagtagcaatactatacgagagtgacgtacgggtgcgtaacacgtatgcaacctaccttgtacaggaggatagctcggggaaactcgaattaaccctccataagatagtggtgaggcatctcacagctattaaaactcaggtggtacaagatgggcatgcgtctgattagctagttggcggtgtaacggaccaccaaggcgatgatcagtaggggaactgagaggttgatcccccacactggcactgagatacgggccagactcctacgggaggcagcagtagggaatattggtcaatggatgcaagtctgaaccagccatgccgcgtgcaggaagaaggccttctgggttgtaaactgcttttgccaggggataaaatgagcgtgcgcgcttaattgaaggtacctggtgaataagccacggctaactacgtgccagcagccgcggtaatacgtaggtggcaagcgttgtccggatttattgggtttaaagggtgcgtaggcggccctgtaagtcagtgctgaaatatcccggcttaaccgggagggtggcattgatactgcagggcttgagtgaagtcgaggtaggcggaattgacggtgtagcggtgaaatgcttagatatcgtcaagaacaccgatagtgaagacagcttactaggcttatactgacgctgaggcacgaaagtgtggggatcaaacaggattagataccctggtagtccacactgtaaacgttgattactcgctgttggcgatatacagccagcggccaagcgcaagcgataagtaatccacctggggagtacgccggcaacggtgaaactcaaaggaattgacgggggtccgcacaagcggtggagcatgtggtttaattcgatgatacgcgaggaaccttacctgggctagaatgcccttgattgcctcagagatgaggagttccgcaaggacaaggagcaaggtgctgcatggctgtcgtcagctcgtgccgtgaggtgttgggttaagtcccgcaacgagcgcaacccttatttttagttgccaacaggttaagctggggactctaaaaagactgcccgcgcaagcggagaggaaggaggggatgacgtcaagtcatcatggcccttacgcccagggctacacacgtgctacaatggcgtatacaaagtgttgcaagccagcgatggtgagccaatcacaaaaagtacgtctcagttcggattgcaggctgcaactcgcctgcatgaagttggaatcgctagtaatcgcgcatcagcaatggcgcggtgaatacgttcccggaccttgtacacaccgcccgtcaagcgatggaagttgggaggacctgaaggcagttgttgtaagacgctgtttagggttaaaccgataactggcgctaagtcgtaacaaggtagccgtaccggaaggtgcggctggaacacctcctttct

SEQ ID NO: 6229 - DNA, 1550 bp, Oleiagrimonas sp. MCCC 1A03011
  ref <308>: DATABASE ACCESSION NUMBER: NCBI ACCESSION: NZ_MSPY01000016.1
  ref <309>: DATABASE ENTRY DATE: 2019-04-01
  ref <313>: RELEVANT RESIDUES IN SEQ ID NO: (1)..(1550)
taagtgaagagtttgatcctggctcagattgaacgctggcggcatgcctaacacatgcaagtcgaacggcagcatgagagagcttgctctcttgatggcgagtggcggacgggtgagtaaggcatcggaatctgccctgttgtgggggacaacccggggaaacccgggctaataccgcatacgtcctacgggagaaagtgggggagccttcgggccctcacgcgacaggatgagccgatgttcgattagtttgttggtggggtaacggcctaccaagacgacgatcgatagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggaacgaaatctgcacggttaatacccgtgtagtctgacggtacctgaggaataagcaccggctaactccgtgccagcagccgcggtaatacggagggtgcaagcgttaatcggaattactgggcgtaaagcgtgcgcaggcggttagttaagtctgctgtgaaagccccgggctcaacctgggaattgcagtggatactggctagctagagtgtggtagaggaaggtggaattcccggtgtagcggtgaaatgcgtagagatcgggaggaacatcagtggcgaaggcggccttctggaccaacactgacgctcatgcacgaaagcgtggggagcaaacaggattagataccctggtagtccacgccctaaacgatgcgaactggacgttggtctcacttcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtccggaacttggtggaaacaccttggtgccttcgggaaccggaacacaggtgctgcatggctgtcgtcagctcgtgtcgtgagatgttgggttaagtcccgcaacgagcgcaacccttgtccttagttgccagcacgtaatggtgggaactctagggagactgccggtgacaaaccggaggaaggtggggatgacgtcaagtcatcatggcccttacgaccagggctacacacgtactacaatggtcggtacagagggttgccaagccgcgaggtggagccaatcccacaaagccgatcccagtccggatcgcagtctgcaactcgactgcgtgaagtcggaatcgctagtaatcgtggatcagctatgccacggtgaatacgttcccgggccttgtacacaccgcccgtcacaccatgggagtgggctgctccagaagccgttagtctaaccttcgggaggacgacgaccacggagtggttcatgactggggtgaagtcgtaacaaggtagccgtatcggaaggtgcggctggatcacctcctttaga

SEQ ID NO: 6230 - DNA, 1493 bp, Oleomonas sp. K1W22B-8
  ref <308>: DATABASE ACCESSION NUMBER: NCBI ACCESSION: NZ_QYUK01000011.1
  ref <309>: DATABASE ENTRY DATE: 2019-04-01
  ref <313>: RELEVANT RESIDUES IN SEQ ID NO: (1)..(1493)
acttgagagtttgatcctggctcagaacgaacgctggcggcatgcctaacacatgcaagtcgaacgtttgtcttcggacaggcgtggcggacgggtgagtaacacgtgggaacctgccccgaggtacgggataacccagggaaacttgggacaataccgtatgtgacctgagggtgaaagattcatcgccttgggatgggcccgcgtcggattaggtagttggtagggtaaaggcctaccaagcctacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgtcggggacgatgatgacggtacccgaagaagaagccccggctaacttcgtgccagcagccgcggtaatacgaagggggctagcgttgttcggaatgactgggcgtaaagggcgcgtaggcggttgatcaagttgggggtgaaagcccggggcttaacctcggaattgccttcaagactggtcagcttgagtgtggaagagggtcgtggaattcccagtgtagaggtgaaattcgtagatattgggaagaacaccagtggcgaaggcgacgacctggtccattactgacgctgaggcgcgacagcgtggggagcaaacaggattagataccctggtagtccacgccgtaaacgatgagtgctggatgttggacggttgccgttcagtgtcgaagttaacgcgataagcactccgcctggggagtacggccgcaaggttgaaactcaaaggaattgacgggggcccgcacaagcggtggagcatgtggtttaattcgaagcaacgcgcagaaccttaccaacccttgacatgggaagtttgggctcgggagactgggtccttcagttcggctggcttccacacaggtgctgcatggctgtcgtcagctcgtgtcgtgagatgttgggttaagtcccgcaacgagcgcaaccctcgcctttagttgccatcaggttaagctgggcactctaaaggaaccgccggtgacaagccggaggaaggtggggatgacgtcaagtcctcatggcccttacgggttgggctacacacgtgctacaatggcagtgacagtgggttgcgaagcagcgatgcggagccaatccccaaaagctgcctcagttcggattgttctctgcaactcgagagcatgaaggcggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaagg

SEQ ID NO: 6231 - DNA, 1497 bp, Oligotropha carboxidovorans
  ref <308>: DATABASE ACCESSION NUMBER: NCBI ACCESSION: NC_017538.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcgtagcaatacgtcagtggcagacgggtgagtatcgcgtgggaacgtaccttttggttcggaacaacacagggaaacttgtgctaataccgaataagcccttacggggaaagatttatcgccgaaagatcggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcggatctttaagtcagaggtgaaagcctggagctcaactccagaactgcctttgatactgaggatctcgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggagggtttactcttcagtggcgcagttaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaggcgcgagccctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 6232 - DNA, 1521 bp, Olleya namhaensis
  ref <308>: DATABASE ACCESSION NUMBER: NCBI ACCESSION: NZ_FORM01000019.1
  ref <309>: DATABASE ENTRY DATE: 2019-04-01
  ref <313>: RELEVANT RESIDUES IN SEQ ID NO: (1)..(1521)
aacgatgaagagtttgatcctggctcaggatgaacgctagcggcaggcttaacacatgcaagtcgaggggtaacattgtgcttgcacagatgacgaccggcgaacgggtgcgtaacgcgtatagaatctacctcttactaagggatagcccagagaaatttggattaataccttatagtatgcagacttggcatcaagactgcattaaagattacggtaggagatgactatgcgtcctattagctagatggtgtggtaacggcacaccatggcaacgataggtaggggccctgagagggggatcccccacactggtactgagacacggaccagactcctacgggaggcagcagtgaggaatattggacaatggaggcaactctgatccagccatgccgcgtgcaggaagactgccctatgggttgtaaactgcttttatacaggaagaaacactgctacgtgtagcagcttgacggtactgtaagaataaggatcggctaactccgtgccagcagccgcggtaatacggaggatccaagcgttatccggaatcattgggtttaaagggtccgtaggtggataattaagtcagaggtgaaatcctgcagctcaactgtagaattgcctttgatactggttatcttgagttattatgaagtagttagaatatgtagtgtagcggtgaaatgcatagatattacatagaataccaattgcgaaggcagattactaataatatactgacactgatggacgaaagcgtggggagcgaacaggattagataccctggtagtccacgccgtaaacgatggtcactagctgttcgaacttcggtttgagtggctaagcgaaagtgataagtgacccacctggggagtacgttcgcaagaatgaaactcaaaggaattgacgggggcccgcacaagcggtggagcatgtggtttaattcgatgatacgcgaggaaccttaccagggcttaaatgtagattgacaggactagagatagttttttcttcggacaatttacaaggtgctgcatggttgtcgtcagctcgtgccgtgaggtgtcaggttaagtcctataacgagcgcaacccctgttgttagttgccagcgagtcatgtcgggaactctaacaagactgccagtgcaaactgtgaggaaggtggggatgacgtcaaatcatcacggcccttacgtcctgggctacacacgtgctacaatggtagggacagagagcagccactgggcgaccaggagcgaatctataaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcgccgtaaggagcggcctagggtaaaatcggtaactagggctaagtcgtaacaaggtagccgtaccggaaggtgcggctggaacacctcctttct

SEQ ID NO: 6233 - DNA, 1522 bp, Olsenella sp. AF15-43LB
  ref <308>: DATABASE ACCESSION NUMBER: NCBI ACCESSION: NZ_QRYL01000021.1
  ref <309>: DATABASE ENTRY DATE: 2019-04-01
  ref <313>: RELEVANT RESIDUES IN SEQ ID NO: (1)..(1522)
gaacggagagttcgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatatgccgccccctccgcatgggaggggcgggaaagctccggcggggggggatgggcccgcggcctgttagctagttggcggggcaacggcccaccaaggcgactatgggtagctgggttgagagaccgaccagccagattgggactgagacacggcccagactcctacgggaggcagcagtggggaatcttgcgcaatgggcggaagcctgacgcagcgacgccgcgtgcgggaggaaggccctcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgctcgtaggcggcctgctaggtcgggagtcaaatgcgggggcccaacccccggccgctcccgataccggcgggcttgagtttggtaggggaaggcggaattcccggtgtagcggtggaatgcgcagatatcgggaagaacaccggtggcgaaggcggccttctgggccacaactgacgctgaggagcgaaagctgggggagcgaacaggattagataccctggtagtcccagccgtaaacgatggacactaggtgtgggggggacgcccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatcttggtgaagcggcggagacgccgtggccgagaggagccaagacaggtggtgcatggctgtcgtcagctcgtgtcgtgagatgttgggttaagtcccgcaacgagcgcaacccccgtcgcatgttgccagcggtccggccgggcacccatgcgagaccgccggcgtcaagccggaggagggcggggacgacgtcaagtcatcatgccccttatgccctgggctgcacacgtgctacaatggccggcacagcgggctgccaggcggcgacgccgagcgaatccccaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgactgcacccgaagtcgccggcccaaccagcaatggggggaggcgccgaaggtgtggctggtaaggggggtgaagtcgtaacaaggtagccgtaccggaaggtgcggctggatcacctcctttctagggag

SEQ ID NO: 6234 - DNA, 1522 bp, Olsenella sp. AF16-14LB; identical to SEQ ID NO: 6233
  ref <308>: DATABASE ACCESSION NUMBER: NCBI ACCESSION: NZ_QRYB01000005.1
  ref <309>: DATABASE ENTRY DATE: 2019-04-01
  ref <313>: RELEVANT RESIDUES IN SEQ ID NO: (1)..(1522)

SEQ ID NO: 6235 - DNA, 1522 bp, Olsenella sp. AF21-51; identical to SEQ ID NO: 6233
  ref <308>: DATABASE ACCESSION NUMBER: NCBI ACCESSION: NZ_QRVQ01000007.1
  ref <309>: DATABASE ENTRY DATE: 2019-04-01
  ref <313>: RELEVANT RESIDUES IN SEQ ID NO: (1)..(1522)

SEQ ID NO: 6236 - DNA, 1522 bp, Olsenella sp. AM04-33; identical to SEQ ID NO: 6233
  ref <308>: DATABASE ACCESSION NUMBER: NCBI ACCESSION: NZ_QRMY01000028.1
  ref <309>: DATABASE ENTRY DATE: 2019-04-01
  ref <313>: RELEVANT RESIDUES IN SEQ ID NO: (1)..(1522)

SEQ ID NO: 6237 - DNA, 1522 bp, Olsenella sp. AM05-17; identical to SEQ ID NO: 6233
  ref <308>: DATABASE ACCESSION NUMBER: NCBI ACCESSION: NZ_QRMW01000002.1
  ref <309>: DATABASE ENTRY DATE: 2019-04-01
  ref <313>: RELEVANT RESIDUES IN SEQ ID NO: (1)..(1522)

SEQ ID NO: 6238 - DNA, 1522 bp, Olsenella sp. AM05-7; identical to SEQ ID NO: 6233
  ref <308>: DATABASE ACCESSION NUMBER: NCBI ACCESSION: NZ_QRMV01000013.1
  ref <309>: DATABASE ENTRY DATE: 2019-04-01
  ref <313>: RELEVANT RESIDUES IN SEQ ID NO: (1)..(1522)

SEQ ID NO: 6239 - DNA, 1522 bp, Olsenella sp. AM30-3LB; identical to SEQ ID NO: 6233
  ref <308>: DATABASE ACCESSION NUMBER: NCBI ACCESSION: NZ_QSJO01000005.1
  ref <309>: DATABASE ENTRY DATE: 2019-04-01
  ref <313>: RELEVANT RESIDUES IN SEQ ID NO: (1)..(1522)

SEQ ID NO: 6240 - DNA, 1522 bp, Olsenella sp. AM39-30AC
  ref <308>: DATABASE ACCESSION NUMBER: NCBI ACCESSION: NZ_QSGV01000022.1
  ref <309>: DATABASE ENTRY DATE: 2019-04-01
  ref <313>: RELEVANT RESIDUES IN SEQ ID NO: (1)..(1522)
gaacggagagttcgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatatgccgccccctccgcatgggaggggcgggaaagctccggcggggggggatgggcccgcggcctgttagctagttggcggggcaacggcccaccaaggcgactatgggtagctgggttgagagaccgaccagccagattgggactgagacacggcccagactcctacgggaggcagcagtggggaatcttgcgcaatgggcggaagcctgacgcagcgacgccgcgtgcgggaggaaggccctcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgctcgtaggcggcctgctaggtcgggagtcaaatgcgggggcccaacccccggccgctcccgataccggcgggcttgagtttggtaggggaaggcggaattcccggtgtagcggtggaatgcgcagatatcgggaagaacaccggtggcgaaggcggccttctgggccacaactgacgctgaggagcgaaagctgggggagcgaacaggattagataccctggtagtcccagccgtaaacgatggacactaggtgtgggggggacgcccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatcttggtgaagcggcggagacgccgtggccgagaggagccaagacaggtggtgcatggctgtcgtcagctcgtgtcgtgagatgttgggttaagtcccgcaacgagcgcaacccccgtcgcatgttgccagcggtccggccgggcacccatgcgagaccgccggcgtcaagccggaggagggcggggacgacgtcaagtcatcatgccccttatgccctgggctgcacacgtgctacaatggccggcacagcgggctgccaggcggcgacgccgagcgaatccccaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgactgcacccgaagtcgccggcccaaccagcaatggggggaggcgccgaaggtgtggctggtaaggggggggaagtcgtaacaaggtagccgtaccggaaggtgcggctggatcacctcctttctagggag

SEQ ID NO: 6241 - DNA, 1529 bp, Olsenella sp. GAM18
  ref <308>: DATABASE ACCESSION NUMBER: NCBI ACCESSION: NZ_AP018530.1
  ref <309>: DATABASE ENTRY DATE: 2019-04-01
  ref <313>: RELEVANT RESIDUES IN SEQ ID NO: (1)..(1529)
atttgaacggagagttcgatcctggctcaggatgaacgctggcggcgcgcctaacacatgcaagtcgaacggttaaggcgcccttcggggcgcgtatagagtggcgaacggctgagtaacacgtgggcaacctgccccccgcaccgggacagcctcgggaaaccgtgggtaataccgggtactccgccacccccgcatgggggaggcgggagagcgtatgcggcgggggatgggcccgcggcctgttagctagttggcggggcaacggcccaccaaggcgattatgggtagctgggttgagagaccgaccagccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaggccgcgaggtgacggtacctgcagaagaagccccggctaactacgtgccagcagccgcggtaatacgtagggggcgagcgttatccggattcattgggcgtaaagcgctcgtaggctgcccgctaggtccggggtcaaatccgggggctcaacccccgcacgccccggataccggcgggcttgagtcgggtaggggaaggcggaattccaggtgtagcggtggaatgcgcagatatctggaagaacaccggtggcgaaggcggccttctgggcctcgactgacgctgaggagcgaaagctgggggagcgaacaggattagataccctggtagtcccagccgtaaacgatggacgctaggtgtgggggggagatgccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagcgcttgacattatggtgaagccggggagacccggtggccgagaggagccataacaggtggtgcatggctgtcgtcagctcgtgtcgtgagatgttgggttaagtcccgcaacgagcgcaacccccgtcgcgtgttgccagcggttcggccgggcacccgcgcgagaccgccggcgtcaagccggaggagggtggggacgacgtcaagtcatcatgccccttatgcgctgggccgcacacgtgctacaatggccggcacaacgggctgccacgccgcaaggcggagcgaatccccaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgcctgcacccgaagtcgccggcccaacccgcgagggggggaggtgccgaaggtgtggctggtaaggggggtgaagtcgtaacaaggtagccgtaccggaaggtgcggctggatcacctcctttctagggag

SEQ ID NO: 6242 - DNA, 1528 bp, Olsenella sp. KCTC 15699
  ref <308>: DATABASE ACCESSION NUMBER: NCBI ACCESSION: NZ_QSNG01000001.1
  ref <309>: DATABASE ENTRY DATE: 2019-04-01
  ref <313>: RELEVANT RESIDUES IN SEQ ID NO: (1)..(1528)
atttgaacggagagttcgatcctggctcaggatgaacgctggcggcgcgcctaacacatgcaagtcgaacggttaaggcgcccttcggggcgcgaatagagtggcgaacggctgagtaacacgtgggcaacctgccccccgcaccgggacagcctcgggaaaccgtgggtaataccgggtactccgccacccccgcatgggggaggcgggagagcgtatgcggcgggggatgggcccgcggcctgttagctagttggcggggcaacggcccaccaaggcgattatgggtagctgggttgagagaccgaccagccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaggccgaaaggtgacggtacctgcagaagaagccccggctaactacgtgccagcagccgcggtaatacgtagggggcgagcgttatccggattcattgggcgtaaagcgctcgtaggctgcccgctaggtccggggtcaaatccgggggctcaacccccgcacgccccggataccggcgggcttgagtcgggtaggggaaggcggaattccaggtgtagcggtggaatgcgcagatatctggaagaacaccggtggcgaaggcggccttctgggcctcgactgacgctgaggagcgaaagctgggggagcgaacaggattagataccctggtagtcccagccgtaaacgatggacgctaggtgtggggggagatgccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagcgcttgacattatggtgaagccggggagacccggtggccgagaggagccataacaggtggtgcatggctgtcgtcagctcgtgtcgtgagatgttgggttaagtcccgcaacgagcgcaacccccgtcgcgtgttgccagcggttcggccgggcacccgcgcgagaccgccggcgtcaagccggaggagggtggggacgacgtcaagtcatcatgccccttatgcgctgggccgcacacgtgctacaatggccggcacaacgggctgccacgccgcaaggcggagcgaatccccaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgcctgcacccgaagtcgccggcccaacccgcaagggggggaggtgccgaaggtgtggctggtaaggggggtgaagtcgtaacaaggtagccgtaccggaaggtgcggctggatcacctcctttctagggag

SEQ ID NO: 6243 - DNA, 1527 bp, Olsenella sp. Marseille-P4518
  ref <308>: DATABASE ACCESSION NUMBER: NCBI ACCESSION: NZ_UWPI01000001.1
  ref <309>: DATABASE ENTRY DATE: 2019-04-01
  ref <313>: RELEVANT RESIDUES IN SEQ ID NO: (1)..(1527)
tttgaacggagagttcgatcctggctcaggatgaacgctggcggcgcgcctaacacatgcaagtcgaacggttaaggcgcccttcggggcgcgaatagagtggcgaacggctgagtaacacgtgggcaacctgccccccgcaccgggacagcctcgggaaaccgtgggtaataccgggtactccgccacccccgcatgggggaggcgggagagcgtatgcggcgggggatgggcccgcggcctgttagctagttggcggggcaacggcccaccaaggcgattatgggtagctgggttgagagaccgaccagccagattgggactgagacgcggcccagactcctacgggaggcagcagtggggaatcttgctcaatgggggcaaccctgacgcagcgacgccgcgtgcgggacgaaggccttcgggtcgtaaaccgctttcagcagggacgaggccgaaaggtgacggtacctgcagaagaagccccggctaactacgtgccagcagccgcggtaatacgtagggggcgagcgttatccggattcattgggcgtaaagcgctcgtaggctgcccgctaggtccggggtcaaatccgggggctcaacccccgcacgccccggataccggcgggcttgagtcgggtaggggaaggcggaattccaggtgtagcggtggaatgcgcagatatctggaagaacaccggtggcgaaggcggccttctgggcctcgactgacgctgaggagcgaaagctgggggagcgaacaggattagataccctggtagtcccagccgtaaacgatggacgctaggtgtggggggagatgccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagcgcttgacattatggtgaagccggggagacccggtggccgagaggagccataacaggtggtgcatggctgtcgtcagctcgtgtcgtgagatgttgggttaagtcccgcaacgagcgcaacccccgtcgcgtgttgccagcggttcggccgggcacccgcgcgagaccgccggcgtcaagccggaggagggtggggacgacgtcaagtcatcatgccccttatgcgctgggccgcacacgtgctacaatggccggcacaacgggctgccacgccgcaaggcggagcgaatccccaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgcctgcacccgaagtcgccggcccaacccgcaagggagggaggtgccgaaggtgtggctggtaaggggggtgaagtcgtaacaaggtagccgtaccggaaggtgcggctggatcacctcctttctagggag

SEQ ID NO: 6244 - DNA, 1522 bp, Olsenella sp. TM06-36; identical to SEQ ID NO: 6233
  ref <308>: DATABASE ACCESSION NUMBER: NCBI ACCESSION: NZ_QSPD01000008.1
  ref <309>: DATABASE ENTRY DATE: 2019-04-01
  ref <313>: RELEVANT RESIDUES IN SEQ ID NO: (1)..(1522)

SEQ ID NO: 6245 - DNA, 1559 bp, Opitutaceae bacterium EW11
  ref <308>: DATABASE ACCESSION NUMBER: NCBI ACCESSION: NZ_QAYY01000001.1
  ref <309>: DATABASE ENTRY DATE: 2019-04-01
  ref <313>: RELEVANT RESIDUES IN SEQ ID NO: (1)..(1559)
ttcggagagtttgatcctggctcagaatgaacgctggcggcgtggttaagacatgcaagtcgaacgggatattcggtgtagcaatacatcggatattcagtggcgaacgggtgcgtaacacgtgaacaatctacctttaagtgtggaatagctcggcgaaagccgaattaataccgcatgtggtggcctctctcctgagagacctactaaagccggggaccgcaaggcctggcgcttgaagaggagttcgcggcctatcagctagttggcgaggtaacggctcaccaaggctaagacgggtagctggtctgagaggatgatcagccacactggaactgagacacggtccagacacctacgggtggcagcagtttcgaatcattcacaatgggcgaaagcctgatggtgcgacgccgcgtgggggacgaaggtcttcggattgtaaacccctgtcaccggggaagaaacgctgcattttaacagaatgcagcctgacttaacccggagaggaagcagtggctaactctgtgccagcagccgcggtaatacagagactgcaagcgttattcggattcactgggcgtaaagggtgcgcaggcggtcgcgtgtgtcaggtgtgaaagcccggagcttaactccggaattgcgcctgaaactacgtgactagagcattggagagggtagcggaattcacggtgtagcagtgaaatgcgtagatatcgtgaggaacaccagaggcgaaggcggctacctggacaattgctgacgctcaggcacgaaagcgtggggagcaaaagggattagatacccctgtagtccacgccctaaacggtgcacactaggtcttggcggattcgaccccaccagggcccaagctaacgcgttaagtgtgccgcctgaggactacggccgcaaggctaaaactcaaaggaattgacgggggcccgcacaagcggtggagcatgtggctcaattcgatgcaacgcgaagaaccttacctggccttgacatgcactagaccggcgctgaaaggcgccctcccttcggggctggtgcacaggtgctgcatggctgtcgtcagctcgtgtcgtgagatgttgcgttaagtcgcgcaacgagcgcaacccctgtccttagttgccaccattaagttgggcactctaaggagacaaaccctctctgagggtgggaaggtggggatgacgtcaagtcaggatggcccttacggccagggctgcacacgtgctacaatgcacggtacagagggacgcaactccgcgaggggaagcaaatcccaaaaaccgtgcccagttcagattgtagtctgcaactcgactacatgaagttggaatcgctagtaatggcgtatcagctacgacgccgtgaatacgttcccgggccttgtacacaccgcccgtcacgtcatgaaagccggtttcgcccgaagtgcgtttgccaaccagcaatggaggcggcgccctaaggtgaagctggtgattgggacgaagtcgtaacaaggtaaccgtaggggaacctgcggttggatcacctcctttcta

SEQ ID NO: 6246 - DNA, 1565 bp, Opitutaceae bacterium TAV1
  ref <308>: DATABASE ACCESSION NUMBER: NCBI ACCESSION: NZ_JH660698.1
  ref <309>: DATABASE ENTRY DATE: 2019-04-01
  ref <313>: RELEVANT RESIDUES IN SEQ ID NO: (1)..(1565)
ttttcggagagtttgatcctggctcagaatgaacgctggcggcgtggttaagacatgcaagtcgaacggggtttttatttgtagcaatacagatgaaaacctagtggcgaacgggtgcgtaacacgtgaacaatctacttcctagtgtggaataattcgccgaaaggtggactaataccgcatgtggttgtttttctcatggaaaacataccaaagacagggaccgcaaggcctgtcgctgggaaaggagttcgcggcctatcagctagttggtgaggtaacggctcaccaaggcaaagacgggtagccggtctgagaggacgaccggccacactggaactgagacacggtccagacacctacgggtggcagcagtttcgaatcattcacaatgggcgaaagcctgatggtgcgacgccgcgtgagggatgaaggtcttcggattgtaaacctctgtcaccggggaagaaacgctgacggttaatagctgttcagcctgacttaacccggagaggaagcagtggctaactctgtgccagcagccgcggtaatacagagactgcgagcgttattcggattcactgggcgtaaagggtgcgcaggcggttgtgtgtgtcagatgtgaaatctcggggcttaaccccgaaactgcgtctgaaactacatgactagagtatcggagagggtagcagaattcatggtgtagcagtgaaatgcgtagatatcatgaggaataccagaggcgaaggcggctacctggacgattactgacgctcaggcacgaaagcgtggggagcaaaagggattagatacccctgtagtccacgccctaaacggtgcatactaggtcttggaggattcgaccccttcagggcccaagctaacgcgttaagtatgccgcctgaggactacggccgcaaggctaaaactcaaaggaattgacgggggcccgcacaagcggtggagtatgtggcttaattcgatgcaacgcgaagaaccttacctggccttgacatgcactggaccgcacctgaaagggtgctttccttcgggaccggtgcacaggtgctgcatggctgtcgtcagctcgtgtcgtgagatgttgcgttaagtcgcgcaacgagcgcaacccctgtccttagttgccatcattaagttgggcactttaaggagacaaactctctctgagagtgggaaggtggggatgacgtcaagtcaggatggcccttacggccagggctgcacacgtactacaatgcccggtacagagggatgcaataccgcgaggtggagctaatcctcaaaaccgggcccagttcggattgtagtctgcaactcgactacatgaagttggaatcgctagtaatggcgcatcagctacggcgccgtgaatacgttcccgggccttgtacacaccgcccgtcacatcatgaaagccggttttgcccaaagtgcgttagccaaccagcaatggaggcggcgccctaaggtgaggctggtgattgggatgaagtcgtaacaaggtaaccgtaggggaacctgcggttggatcacctcctttctaa

SEQ ID NO: 6247 - DNA, 1568 bp, Opitutaceae bacterium TAV3
  ref <308>: DATABASE ACCESSION NUMBER: NCBI ACCESSION: NZ_LXWT02000003.1
  ref <309>: DATABASE ENTRY DATE: 2019-04-01
  ref <313>: RELEVANT RESIDUES IN SEQ ID NO: (1)..(1568)
ttttcggagagtttgatcctggctcagaatgaacgctggcggcgtggttaagacatgcaagtcgaacgggatttatgatgtagcaatacattgtgaatctagtggcgaacgggtgcgtaacacgtgaacaatctacttcttagtgtggaataattcgccgaaaggtggactaataccgcatgtggttgtttccctcatgggaagcatactaaaggcagggaccgcaaggcctgccgctaggaaaggagttcgcggcctatcagctagttggtgaggtaacggctcaccaaggcaaagacgggtagccggtctgagaggatgatcggccacactggaactgagacacggtccagacacctacgggtggcagcagtttcgaatcattcacaatgggcgaaagcctgatggtgcgacgccgcgtgagggatgaaggtcttcggattgtaaacctctgtcactagggaagaaacgctggcgattaatagtcgtccagcctgacttaacctggagaggaagcagtggctaactctgtgccagcagccgcggtaatacagagactgcaagcgttattcggattcactgggcgtaaagggtgcgcaggcggttgtgtgtgtcaggtgtgaaatctcggggcttaactccgaaactgcgcctgaaactacacaactagagtattggagagggtagcagaattcatggtgtagcagtgaaatgcgtagatatcatgaggaataccagaggcgaaggcggctacctggacaattactgacgctcaggcacgaaagcgtggggagcaaaagggattagatacccctgtagtccacgccctaaacggtgcatactaggtcttggaggattcgaccccttcagggcccaagctaacgcgttaagtatgccgcctgaggactacggccgcaaggctaaaactcaaaggaattgacgggggcccgcacaagcggtggagtatgtggcttaattcgatgcaacgcgaagaaccttacctagccttgacatgcattagacagacgctgaaaggcgtccttccttcgggactggtgcacaggtgctgcatggctgtcgtcagctcgtgtcgtgagatgttgcgttaagtcgcgcaacgagcgcaacccctgtccttagttgccatcattaagttgggcactttaaggagacaaaccctctctgagggtgggaaggtggggatgacgtcaagtcaggatggcccttacggctagggctgcacacgtactacaatgcccgatacagagagatgcaataccgtgaggtggagctaatcttcaaaatcgggcccagttcggattgttgtctgcaactcgacaacatgaagttggaatcgctagtaatggcgcatcagctacggcgccgtgaatacgttcccgggccttgtacacaccgcccgtcacatcatgaaagccggttttgcccaaagtgcgtttgccaaccagcaatggaggcggcgccctaaggtgaggctggtgattgggatgaagtcgtaacaaggtaaccgtaggggaacctgcggttggatcacctcctttctaaggaga

SEQ ID NO: 6248 - DNA, 1565 bp, Opitutaceae bacterium TAV5; identical to SEQ ID NO: 6246
  ref <308>: DATABASE ACCESSION NUMBER: NCBI ACCESSION: NZ_CP007053.1
  ref <309>: DATABASE ENTRY DATE: 2019-04-01
  ref <313>: RELEVANT RESIDUES IN SEQ ID NO: (1)..(1565)

SEQ ID NO: 6249 - DNA, 1563 bp, Opitutaceae bacterium TSB47
  ref <308>: DATABASE ACCESSION NUMBER: NCBI ACCESSION: NZ_KV441840.1
  ref <309>: DATABASE ENTRY DATE: 2019-04-01
  ref <313>: RELEVANT RESIDUES IN SEQ ID NO: (1)..(1563)
ctttttggagagtttgatcctggctcagaatgaacgctggcggcgtggttaagacatgcaagtcgaacgggacttacggtgtagcaatacactgtaagttcagtggcgaacgggtgcgtaacacgtaaacaatctacctttcagtggggaatagctcggtgaaaaccgaattaataccgcatgtggtggtttctctcctgaggaacttactaaagacagggaccgcaaggcctgtcgctggaagaggagtttgcggcctatcagctagttggtgaggtaacggctcaccaaggctaagacgggtagctggtctgagaggatgatcagccacactggaactgagacacggtccagacacctacgggtggcagcagtttcgaatcattcacaatgggcgaaagcctgatggtgcgacgccgcgtgagggacgaaggccttcgggttgtaaacctctgtcaccggggaagaaacgctatgagctaacagttcatagcctgacttaacccggagaggaagcagtggctaactctgtgccagcagccgcggtaatacagagactgcaagcgttattcggattcactgggcgtaaagggtgcgcaggcggccatgtgtgtctggtgtgaaatcccggggcttaactccggaattgcgccggaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcgaaagggattagatacccctgtagtccacgccctaaacggtgcacactaggtcttggaggattcgaccccttcagggcccaagctaacgcgttaagtgtgccgcctgaggactacggccgcaaggctaaaactcaaaggaattgacgggggcccgcacaagcggtggagcatgtggcttaattcgatgcaacgcgaagaaccttacctggccttgacatgcactagaccgacgctgaaaggcgtcttcccttcggggctggtgcacaggtgctgcatggctgtcgtcagctcgtgtcgtgagatgttgcgttaagtcgcgcaacgagcgcaacccctgtccttagttgccatcattaagttgggcactctaaggagacaaaccctctctgagggtgggaaggtggggatgacgtcaagtcaggatggcccttacggccagggctgcacacgtgctacaatgcccgatacagagggatgcaatgccgcgaggcaaagcgaatctcaaaaatcgggcccagttcagattgcagtctgcaactcgactgcatgaagttggaatcgctagtaatggcgcatcagctacggcgccgtgaatacgttcccgggccttgtacacaccgcccgtcacatcatgaaagccggtttcgcccgaagtgcgttagccaaccagcaatggaggcggcgccctaaggtgaagctggtgattgggatgaagtcgtaacaaggtaaccgtaggggaacctgcggttggatcacctcctttctaa

SEQ ID NO: 6250 - DNA, 1560 bp, Opitutus sp. ER46
  ref <308>: DATABASE ACCESSION NUMBER: NCBI ACCESSION: NZ_QAYX01000024.1
  ref <309>: DATABASE ENTRY DATE: 2019-04-01
  ref <313>: RELEVANT RESIDUES IN SEQ ID NO: (1)..(1560)
ttcggagagtttgatcctggctcagaatgaacgctggcggcgtggttaagacatgcaagtcgaacgggactttctgaagggcaaccggatgaaagttcagtggcgaacgggtgcgtaacacgtgaacaatctacctcgaagtgtggaatagctcggcgaaagccgaattaataccgcatgtggtcagttcccgcatgggagttgaactaaagtcagggaccgcaaggcctgacgctttgagaggagttcgcggcctatcagctagttggcgaggtaacggctcaccaaggctaagacgggtagctggtctgagaggatgatcagccacactggaactgagacacggtccagacacctacgggtggcagcagtttcgaatcattcacaatgggcgaaagcctgatggtgcgacgccgcgtgagggatgaaggtcttcggattgtaaacctctgtcaccggggaagaaacgcttcatgttaatagtatgaagcctgacttaacccggagaggaagcagtggctaactctgtgccagcagccgcggtaatacagagactgcaagcgttattcggattcactgggcgtaaagggtgcgcaggcggccgtgtgtgtgaggcgtgaaagcccggggcttaaccccggaattgcacctcaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaagggattagatacccctgtagtccacgccctaaacggtgcacactaggtcttggcggattcgacccccccagggcccaagctaacgcgttaagtgtgccgcctgaggactacggccgcaaggctaaaactcaaaggaattgacgggggcccgcacaagcggtggagtatgtggctcaattcgatgcaacgcgaagaaccttaccaggccttgacatgcattagaccggcgctgaaaggcgccttcccttcggggctggtgcacaggtgctgcatggctgtcgtcagctcgtgtcgtgagatgttgcgttaagtcgcgcaacgagcgcaacccctgtccttagttgccatcaggtaaagctgggcactctagggagacaaaccctctttgagggtgggaaggtggggatgacgtcaagtcaggatggcccttacggcctgggctgcacacgtactacaatgcccggtacagagggaagcaataccgcgaggtggagcaaatcctcaaaaccgggcccagttcagattgtagtctgcaactcgactacatgaagttggaatcgctagtaatggcgcatcagctacggcgccgtgaatacgttcccgggccttgtacacaccgcccgtcacgtcatgaaagccggtttcgcccgaagtgcgtttgccaaccagcaatggaggcggcgccctaaggtgaggctggtgattgggacgaagtcgtaacaaggtaaccgtaggggaacctgcggttggatcacctcctttct

SEQ ID NO: 6251 - DNA, 1565 bp, Opitutus terrae
  ref <308>: DATABASE ACCESSION NUMBER: NCBI ACCESSION: NC_010571.1
  ref <309>: DATABASE ENTRY DATE: 2019-04-01
  ref <313>: RELEVANT RESIDUES IN SEQ ID NO: (1)..(1565)
tttcggagagtttgatcctggctcagaatgaacgctggcggcgtggttaagacatgcaagtcgaacggtttttccggtgtagcaatacatcggaaagacagtggcgaacgggtgcgtaacacgtgaacaatctacctccaaatggggaatagctcggcgaaagccggattaataccgcatgtggttgcttctcgcatgagaggtataccaaagtcggggaccgcaaggcctgacgttaggagaggagttcgcggcctatcagctagttggcgaggtaacggctcaccaaggcaaagacgggtagctggtctgagaggatgatcagccacactggaactgagacacggtccagacacctacgggtggcagcagtttcgaatcattcacaatgggcgaaagcctgatggtgcgacgccgcgtgagggatgaaggtcttcggattgtaaacctctgtcaccggggaagaaacgctttatattaatcgtataaagcctgacttaacccggagaggaagcagtggctaactctgtgccagcagccgcggtaatacagagactgcgagcgttattcggattcactgggcgtaaagggtgcgcaggcggccgggtgtgtggggcgtgaaagcctggagcttaactccagaattgcgcctcaaactacacggctagagcattggagagggtagcggaattcacggtgtagcagtgaaatgcgtagatatcgtgaggaacaccagaggcgaaggcggctacctggacaattgctgacgctcaggcacgaaagcgtggggagcaaaagggattagatacccctgtagtccacgccctaaacggtgcacactaggtcttggcggattcgacccctccagggccccagctaacgcgttaagtgtgccgcctgaggactacggccgcaaggctaaaactcaaaggaattgacgggggcccgcacaagcggtggagtatgtggctcaattcgatgcaacgcgaagaaccttaccaagccttgacatgcattggacaggcgctgaaaggcgccctcccttcggggccggtgcacaggtgctgcatggctgtcgtcagctcgtgtcgtgagatgttgcgttaagtcgcgcaacgagcgcaacccctgtccttagttgccatcattcagttgggcactctagggagacaaaccctctttgagggtgggaaggtggggatgacgtcaagtcaggatggcccttacggcttgggctgcacacgtactacaatgcccggtacagagggacgcaataccgcgaggtggagcaaatcctcaaaaccgggcccagttcagattgtagtctgcaactcgactacatgaagttggaatcgctagtaatggcgcatcagctacggcgccgtgaatacgttcccgggccttgtacacaccgcccgtcacgtcatgaaagccggtttcgcccgaagtgcgtttgccaaccagcaatggaggcggcgccctaaggtgaggctggtgattgggacgaagtcgtaacaaggtagccgtaggggaacctgcggctggatcacctcctttctaaggag

SEQ ID NO: 6252 - DNA, 1551 bp, Orenia marismortui
  ref <308>: DATABASE ACCESSION NUMBER: NCBI ACCESSION: NZ_KB900617.1
  ref <309>: DATABASE ENTRY DATE: 2019-04-01
  ref <313>: RELEVANT RESIDUES IN SEQ ID NO: (1)..(1551)
ttttattggagagtttgatcctggctcaggacgaacgctggcggcgtgcttaacacatgcaagttgaacgcgaaagttaccttcgggtaatgagtagagtagcggacgggtgagtaacgcgtgggttatctacctttaagttagggataacctctcgaaagaggggctaatacctgataatctcttacgagcaaagatggcttcttcttagctatcgcttaaagatgagcctgcgtcccattagctagttggtgaggtaagagctcaccaaggcgacaatgggtagccgacctgagagggtgatcggccacactgggactgagacacggcccagactcctacgggaggctgcagtggggaatcttccgcaatggacgaaagtctgacggagcaacgccgcgtgaatgatgaaggccttcgggtcgtaaaattctgtccttagggaagaatattttggttgttaataacagctgaagttgacggtacctttggaggaagccctggctaactacgtgccagcagccgcggtaatacgtagagggcaagcgttgtccggaatcattgggcgtaaagggtacgcaggcggtctagtaagtcagaggtgaaatccaccggctcaaccggtgaactgcctttgatactgctagacttgaggataagagaagaaagcggaattcctagtgtagtggtgaaatacgtagatattaggaagaataccaatggcgaaagcagctttctaacttactcctgacgctcaggtacgaaagctagggtagcaaacgggattagataccccggtagtcctagccgtaaacgatggatactaggtgttggaggttcgattccttcggcgccgcagttaacgcattaagtatcccgcctggggattacgaccgcaaggttgaaactcaaaggaattgacgggggcccgcacaagcggtggagcatgtggtttaattcgatgcaacgcgaagaaccttaccagaacttgacatccctgtgactatttcttaaccgaaagtctcctctttgaggacacagaagacaggtggtgcatggctgtcgtcagctcgtgtcgtgagatgttgggttaagtcccgtaacgagcgcaacccctatccttagttgccagcacgtaatggtggggactctaaggagactgccgcggaaaaacgcggaggaaggtggggatgacgtcaagtcatcatgccccttatgttctgggctacacacgtgctacaatggtctatacagagggtggctacaccgcgaggtgatgctaatctctaaagtagatctcagttcggattgcaggctgaaactcgcctgcatgaagctggaatcgctagtaatcgcggatcagaatgccgcggtgaatacgttcccgggccttgtacacaccgcccgtcacaccacccgagtcgggggcaccagaagtcatcggcccaacttagtgagggagatgccgaaggtgtgcctggtaaggggggtgaagtcgtaacaaggtagccgtaccggaaggtgcggctggatcacctcctttctaaggag

SEQ ID NO: 6253 - DNA, 1508 bp, Orientia tsutsugamushi
  ref <308>: DATABASE ACCESSION NUMBER: NCBI ACCESSION: NZ_LS398548.1
  ref <309>: DATABASE ENTRY DATE: 2019-04-01
  ref <313>: RELEVANT RESIDUES IN SEQ ID NO: (1)..(1508)
aaacttaagagtttgatcctggctcagaacgaacgctggcggcatgcctaacacatgcaagtcgaacgaattaatgctgagcttgcttagcattaattagtggcaaacgggtgagtaacacgtgggaatctgcccatcagtacggaataacatttagaaataagtgctaataccgtatgccctctacaaggaggaaagatttatcgctgatggatgagcccgcggcagattaggtagttggtaaggtaatggcttaccaagcctgtgatctgtagctggtctgagaggacgaacagccacactgggactgagacacggcccagactcctacggggggcagcagtggggaatattggacaatgggcgaaagcctgatccagcaatgccgcgtgagtgatgaaggccttagggttgtaaagctcttttagtagggatgataatgacagtacctacagaaaaagccccggctaactccgtgccagcagccgcggtaagacggagggggctagcgttgttcggaattactgggcgtaaagggcgcgtaggcggtttaataagttaggagtgaaatcccggggcttaaccctggaactgcttctaaaactgttaggctagagtatggtagaggatgatggaatttctagtgtagaggtaaaattcttagatattagaaggaacaccagtggcgaaagctgtcatctgggccattactgacgctgaggcgcgaaagcgtggggagcaaacaggattagataccctggtagtccacgctgtaaacgatgagtgctagatattgggggatttttctttcagtttcgtagctaacgcattaagcactccgcctggggagtacggtcgcaagattaaaactcaaaggaattgacgggggcccgcacaagcggtggagcatgcggtttaattcgatgatccgcgaaaaaccttaccaactcttgacatggtagtcgcgaaaaatggagacatttttcttcagtttggctggactacacacaggtgttgcatggctgtcgtcagctcgtgtcgtgagatgttgggttaagtcccgcaacgagcgcaacccttattcttatttgccagcgggtaatgccgggaactataggaaaactgccggtgctaagccggaggaaggtggggatgaggtcaagtcatcatggcccttatgagttgggctacacgcgtgctacaatggtacctacagagtgatgcgatacggtgacgtggagctaatcattaaaaggtatctcagttcggattgcactctgcaactcgagtgcatgaagtcggaatcgctagtaatcgcggatcagcatgccgcggtgaatacgttctcgggccttgtacacactgcccgtcgcaccatgggagtcagtggtacctgaagttggtgagctaacgtaagaggcagctaaccacggtagaactggtgactggggtaaagtcgtaacaaggtagccgtaggggaacctgcggctggattacctcctttaaag

SEQ ID NO: 6254 - DNA, 667 bp, Ornithinibacillus californiensis
  ref <308>: DATABASE ACCESSION NUMBER: NCBI ACCESSION: NZ_LDUE01000001.1
  ref <309>: DATABASE ENTRY DATE: 2019-04-01
  ref <313>: RELEVANT RESIDUES IN SEQ ID NO: (1)..(667)
gagtaacacgtgggcaacctgcctgtaagactgggataactcgcggaaacgtgagctaataccggataatactttgaacttcatggttcgaagatgaaaggcggcttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtcgggtagtaactgacccgaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcg

SEQ ID NO: 6255 - DNA, 1475 bp, Ornithinibacillus contaminans
  ref <308>: DATABASE ACCESSION NUMBER: NCBI ACCESSION: NZ_LDPV02000008.1
  ref <309>: DATABASE ENTRY DATE: 2019-04-01
  ref <313>: RELEVANT RESIDUES IN SEQ ID NO: (1)..(1475)
ggtgacgagatgtggaacgagcggcggacgggtgagtaacacgtgggcaacctgcctgtaagactgggataacttcgggaaaccggagctaataccggataaaacttattaccacatggtgaaaagatgaaaggcggcgcaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtcgggtagtaactgacccggccgtgacggtacctaaccagaaagccccggctaactacgtgccagcagccgcggtaatacgtagggggcgagcgttgtccggaattattgggcgtaaagcgcgcgcaggcggtcctttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacactcctagagataggaatttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaaggtagccgtatcggaaggtgcggctggatcacctcctttctaa

SEQ ID NO: 6256 - DNA, 1567 bp, Ornithinibacillus halophilus
  ref <308>: DATABASE ACCESSION NUMBER: NCBI ACCESSION: NZ_FQVW01000109.1
  ref <309>: DATABASE ENTRY DATE: 2019-04-01
  ref <313>: RELEVANT RESIDUES IN SEQ ID NO: (1)..(1567)
ttttttggagagtttgatcttggctcaggacgaacgctggcggcgtgcctaatacatgcaagtcgagcgcgtgaatctcactgaactcttcggagggacgtgagtggatcgagcggcggacgggtgagtaacacgtgggcaacctgcctgtaagactgggataactcgcggaaacgtgagctaataccggataatacttttaatcacatggttagaagatgaaaggcggcttttgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtactagagtaactgctagtaccttgacggtacctaaccagaaagccccggctaactacgtgccagcagccgcggtaatacgtagggggcaagcgttgtccggaattattgggcgtaaagcgcgcgtaggcggtcctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacacccctagagatagggctttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacagagggcagcgaaaccgtgaggtgaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgcctaaggtgggaccaatgattggggtgaagtcgtaacaaggtagccgtatcggaaggtgcggctggatcacctcctttctaa

SEQ ID NO: 6257 - DNA, 1557 bp, Ornithinibacillus scapharcae
  ref <308>: DATABASE ACCESSION NUMBER: NCBI ACCESSION: NZ_AEWH01000025.1
  ref <309>: DATABASE ENTRY DATE: 2019-04-01
  ref <313>: RELEVANT RESIDUES IN SEQ ID NO: (1)..(1557)
agagtttgatcttggctcaggacgaacgctggcggcgtgcctaatacatgcaagtcgagcgagtgaaactaactgatccctccggggtgacgttagtggatctagcggcggacgggtgagtaacacgtgggcaacctgcctgtaagactgggataactcgcggaaacgcgagctaataccggatgatactttgaactgcatggttcgaagatgaaaggcggcgcaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgttcttagttgccagcatttagttgggcactctaaggagactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaaggtagccgtatcggaaggtgcggctggatcacctcctttct

SEQ ID NO: 6258 - DNA, 1126 bp, Ornithinimicrobium sp. CPCC 203383
  ref <308>: DATABASE ACCESSION NUMBER: NCBI ACCESSION: NZ_QZMN01000029.1
  ref <309>: DATABASE ENTRY DATE: 2019-04-01
  ref <313>: RELEVANT RESIDUES IN SEQ ID NO: (1)..(1126)
tgtaaataccttaacgaggaacaattggagggcaagtctggtgccagcagccgcggtaattccagctccaatagcgtatattaaagttgttgcagttaaaaagctcgtagttgaactttgggcccggttggccggtccgattttttcgtgtactggatttccaacggggcctttccttctggctaaccttgagtccttgtggctcttggcgaaccaggacttttactttgaaaaaattagagtgttcaaagcaggcgtattgctcgaatatattagcatggaataatagaataggacgtttggttctattttgttggtttctaggaccatcgtaatgattaatagggacggtcgggggcatcagtattcaattgtcagaggtgaaattcttggatttattgaagactaactactgcgaaagcatttgccaaggacgttttcattaatcaagaacgaaagttaggggatcgaagatgatcagataccgtcgtagtcttaaccataaactatgccgactagggatcgggtggtgtttttttaatgacccactcggcaccttacgagaaatcaaagtctttgggttctggggggagtatggtcgcaaggctgaaacttaaaggaattgacggaagggcaccaccaggagtggagcctgcggcttaatttgactcaacacggggaaactcaccaggtccagacacaataaggattgacagattgagagctctttcttgattttgtgggtggtggtgcatggccgttcttagttggtggagtgatttgtctgcttaattgcgataacgaacgagaccttaacctactaaatagtggtgctagcatttgctggttatccacttcttagagggactatcggtttcaagccgatggaagtttgaggcaataacaggtctgtgatgcccttagacgttctgggccgcacgcgcgctacactgacggagccagcgagtctaaccttggccgagaggtcttggtaatcttgtgaaactccgtcgtgctggggatagagcattgtaattattgctcttcaacgaggaattcctagtaagcgcaagtcatcagcttgcgttgattacgtccctgccctttgtacacaccgcccgtcgct

SEQ ID NO: 6259 - DNA, 1492 bp, Oscillatoria acuminata
  ref <308>: DATABASE ACCESSION NUMBER: NCBI ACCESSION: NC_019693.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtctgcttaacacatgcaagtcgaacggtgaaccctcgggttcatagtggcggacgggtgagtaacacgtgagaatctgcctccaggtcggggacaacagtgggaaactgctgctaatacccgatgtgcctacgggtgaaagattaattgcctggagatgagctcgcgtccgattagctagttggtaaggtaaaggcttaccaaggctccgatcggtagctggtctgagaggatgagcagccacactgggactgagacacggcccagactcctacgggaggcagcagtggggaattttccgcaatgggcgaaagcctgacggagcaagaccgcgtgggggatgaaggctcttgggttgtaaaccccttttctcagggaagaagttctgacggtacctgaggaataagcatcggctaactccgtgccagcagccgcggtaagacggaggatgcaagcgttatccggaattattgggcgtaaagcgttcgtaggtggctgttcaagtctgccgttaaagaccggggcttaactccggaaaaactgtggaaactgaacagctagagtatggtaggggtaagggggaattcccggtgtagcggtgaaatgcgtagatatcgggaagaacaccggtggcgaaggcgccttactgggccataactgacactgagggacgaaagctaggggagcgaaagggattagatacccctgtagtcctagctgtaaacgatggatactaggtgttgcccgtatcgacccgggcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccagaatcttggggaaacttgagagtgccttcgggagctggaacacaggtggtgcatggctgtcgtcagctcgtgtcgtgagatgttgggttaagtcccgcaacgagcgcaaccctcgtccttagttgccatcattaagttgggcactttagggagactgccggtgacaaaccggaggaaggtggggatgacgtcaagtcagcatgccccttacgtcctgggctacacacgtactacaatgggaaggacagagggtagcaagcgcgcgagtgcaagccaatcccataaacctttcctcagttcagattgaagtttgcaactcaacttcatgaaggcggaatcgctagtaatcgcaggtcagcatactgcggtgaatacgttcccgggccttgtacacaccgcccgtcacaccatggaagttggccatgcccgaagtcattaccctaaccgcaaggagggggatgccgaaggcagggctgatgactggggtgaagtcgtaacaaggtagccgtaccggaaggtgtggctggatcacctcctttt

SEQ ID NO: 6260 - DNA, 1508 bp, Oscillatoria nigro-viridis
  ref <308>: DATABASE ACCESSION NUMBER: NCBI ACCESSION: NC_019729.1
  ref <309>: DATABASE ENTRY DATE: 2019-04-01
  ref <313>: RELEVANT RESIDUES IN SEQ ID NO: (1)..(1508)
aacacggagagtttgatcctggctcaggatgaacgctggcggtctgcttaacacatgcaagtcgaacggagtagaaatacttagtggcggacgggtgagtaacgcgtgagaatctgccttcaggacggagacaacagttggaaacgactgctaagccccgatgaaccgaaagggaaaatatttatagcctgaagatgagctcgcgtccgattagctagttggcggagtaaaagcccaccaaggcgacgatcggtagctggtctgagaggacgatcagccacactgggactgagacacggcccagactcctacgggaggcagcagtggggaattttccgcaatgggcgaaagcctgacggagcaagaccgcgtgggggaagaaggctcttgggttgtaaaccccttttctctgggaagaaagttgtgaaagcaacctgacggtaccagaggaatcagcatcggctaactccgtgccagcagccgcggtaagacggaggatgcaagcgttatccggaatgattgggcgtaaagcgtccgcaggtggcagttcaagtctgctgtcaaagaccggggcttaacttcggaaaggcagtggaaactgaacagctagagtatggtaggggcagagggaattcctggtgtagcggtgaaatgcgtagagatcaggaagaacatcggtggcgaaggcgctctgctggaccataactgacactcagggacgaaagctaggggagcgaatgggattagataccccagtagtcctagccgtaaacgatggatactaggtgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatcttctggaaacagaggagtgccttcgggagcgcgaacacaggtggtgcatggctgtcgtcagctcgtgtcgtgagatgttgggttaagtcccgcaacgagcgcaaccctcgtgtttagttgccatcattaagttgggcactctaaacagactgccggtgacaaaccggaggaaggtggggatgacgtcaagtcagcatgccccttacgttctgggctacacacgtactacaatggtagggacagagggcagccaacccgcgagggcgagctaatcccgtaaaccctgcctcagttcagattgcaggctgcaactcgcctgcatgaaggcggaatcgctagtaatcgcaggtcagcatactgcggtgaatccgttcccgggccttgtacacaccgcccgtcacaccatggaagttggccacgcccgaagtcattactctaacctttcgaggaggaggatgccgaaggcagggctgatgactggggtgaagtcgtaacaaggtagccgtaccggaaggtgtggctggatcacctccttttagggaga

SEQ ID NO: 6261 - DNA, 1492 bp, Oscillatoria sp. PCC 10802
  ref <308>: DATABASE ACCESSION NUMBER: NCBI ACCESSION: NZ_KB235948.1
  ref <309>: DATABASE ENTRY DATE: 2019-04-01
  ref <313>: RELEVANT RESIDUES IN SEQ ID NO: (1)..(1492)
cacggagagtttgatcctggctcaggatgaacgctggcggtctgcttaacacatgcaagtcgaacgggaggagaaatcctctagtggcggacgggtgagtaacgcgtgagaatctgccttcaggtcggggacaacagctggaaacggctgctaagacccgatgtgccgagaggtgaaagatttatcgcctgaagatgagctcgcgtccgattagctagttggtagggttatagcctaccaaggcgacgatcggtaactggtctgagaggacgaccagtcacactgggactgagacacggcccagactcctacgggaggcagcagtggggaattttccgcaatgggcgaaagcctgacggagcaagaccgcgtgagggacgaaggctcttgggttgtaaacctcttttctcagggaagaaacctgacggtacctgaggaataagcatcggctaactccgtgccagcagccgcggtaagacggaggatgcaagcgttatccggaatgattgggcgtaaagcgttcgcaggtggctgttcaagtcggctgtcaaagactggggcttaaccccggaaaggcagtggaaactgaacggctagagtgcattaggggtagagggaattcccagtgtagcggtgaaatgcgtagagattgggaagaacaccggtggcgaaagcgctctgctggactgcaactgacactgagggacgaaagctaggggagcgaaagggattagatacccctgtagtcctagccgtaaacgatggatactaggcgttgccgggctcgaccctggcagtgccggagctaacgcgttaagtatcccgcctgggaagtacgcacgcaagtgtgaaactcaaaggaattgacgggggcccgcacaagcggtggagtatgtggtttaattcgatgcaacgcgaagaaccttaccagggcttgacatgtcgcgaaccccgctgaaaggtgggggtgccttagggagcgcgaacacaggtggtgcatggctgtcgtcagctcgtgtcgtgagatgttgggttaagtcccgcaacgagcgcaaccctcgtgttcagttgccatcattaagttgggaactctgaacagactgccggtgacaaaccggaggaaggtggggatgacgtcaagtcagcatgccccttacgtcctgggcaacacacgtactacaatgctgcggacagagggtagcgagccggtgacggcaagccaatcccgcaaaccgtggctcagttcagatcgcaggctgcaactcgcctgcgtgaaggcggaatcgctagtaatcgcaggtcagcatactgcggtgaatacgttcccgggccttgtacacaccgcccgtcacaccatgggagctggtttagcccgaagtcgttactctaaccgaaagggggaggacgccgaaggctgggctggtgactggggtgaagtcgtaacaaggtagccgtaccggaaggtgtggctggatcacctcctttttaggga

SEQ ID NO: 6262 - DNA, 1498 bp, Oscillatoriales cyanobacterium JSC-12
  ref <308>: DATABASE ACCESSION NUMBER: NCBI ACCESSION: NZ_CM001633.1
  ref <309>: DATABASE ENTRY DATE: 2019-04-01
  ref <313>: RELEVANT RESIDUES IN SEQ ID NO: (1)..(1498)
attcaacatggagagtttgatcctggctcaggatgaacgctggcggtatgcttaacacatgcaagtcgaacggggtactttcgggtacctagtggcggacgggtgagtaacgcgtgagaatctggctataggttcgggacaacattgggaaactgatgctaataccggatgtgccgagaggtgaaagcttaatgtgcctatagatgagctcgcgtccgattagctagtaggtgaggtaaaagctcacctaggccatgatcggtagctggtctgagaggatggccagccacactgggactgagacacggcccagactcctacgggaggcagcagtggggaattttccgcaatgggcgaaagcctgacggagcaataccgcgtgagggaggaaggcttttgggtcgtaaacctcttttctctgggaagaagttctgacggtaccagaggaatcagcatcggctaactccgtgccagcagccgcggtaatacggaggatgcaagcgttatccggaattattgggcgtaaagcgtccgcaggtggttattcaagtctgctgttaaagcgtggagcttaactccatatcggcagtggaaactggatgactagagttcggtaggggtagcgggaattcccagtgtagcggtgaaatgcgtagatattgggaagaacaccagcggcgaaagcgcgctactgggccgagactgacactgagggacgaaagctaggggagcgaaagggattagatacccctgtagtcctagctgtaaacgatgggcactaggtgttgcgcgtatcgacccgtgcagtgccgtagctaacgcgttaagtgccccgcctggggagtacgcacgcaagtgtgaaactcaaaggaattgacgggggcccgcacaagcggtggagtatgtggtttaattcgatgcaacgcgaagaaccttaccagggcttgacatgtgcagaatctccttgaaaaaggagagtgccttcgggaactgcaacacaggtggtgcatggctgtcgtcagctcgtgtcgtgagatgttgggttaagtcccgcaacgagcgcaaccctcgtccttagttgccagcattgagttgggcactctggggagactgccggtgacaaaccggaggaaggtggggatgacgtcaagtcagcatgccccttacgtcctgggctacacacgtactacaatgctgtggacaaagagctgcaagtcggcgacgacaagccaatctcggaaaccacggctcagttcagattgcaggctgcaactcgcctgcatgaaggaggaatcgctagtaatcgcaggtcagcatactgcggtgaatacgttcccgggccttgtacacaccgcccgtcacaccatgggagttggccacgcccgaagtcgttactccaactgcttgcagagggggacgccgaaggcagggctgatgactggggtgaagtcgtaacaaggtagccgtaccggaaggtgtggctggatcacctcctttt

SEQ ID NO: 6263 - DNA, 1418 bp, Oscillochloris trichoides
  ref <308>: DATABASE ACCESSION NUMBER: NCBI ACCESSION: NZ_GL501405.1
  ref <309>: DATABASE ENTRY DATE: 2019-04-01
  ref <313>: RELEVANT RESIDUES IN SEQ ID NO: (1)..(1418)
gacgaacgctggcggcgtgcctaatgcatgcaagtcgaacgcagcaagcgtgcttggctgcgtggcgcacggctgaggaacacgtgggtcatctgccctcaagtgggggataactcggcgaaagccaagctaatcccgcatacgctcgcaagaggaaagcggcaacgcgcttgaggatgagcctgcggcccatcaggtagttggtagggtaacggcctaccaagccagtgacgggtccctggtctgagaggacgaccaggcagactgggactgagacacggcccagactcctacgggaggcagcagcaaggaattttccccaatggacgcaagtctgagggagcaacgccgcgtggaggatgacggccttcgggttgtaaactccttttgctggggaagataatgacggtacccggcgaagaagccccggctaactccgtgccagcagccgcggtaagacggagggggcaagcgttgtccggactcactgggcgtaaagcgcacgtaggcggtcgtctgcgtcggtgctgaaagcgccaggcttaacctggcgaggcgtgccgatacgagacgacttgaggcaggcagaggatggcggaattccgggtgtagtggtgaaatgcgtagagatccggaggaacgcctgtggcgcaagcggccatctgggcctgacctgacgctgaggtgcgaaagcgtggggagcgaaccggattagatacccgggtagtccacgctgtaaacgatgccagctcggtgtctgttcccattacgggagtgggtgcctaagctcacgcggtaagctggccgcctggggactacgagcgcaagcttaaaactcaaaggaattgacgggggcccgcacaagcagcggagcgtgtggtttaattcgacgcaacgcgaagaaccttacccaggcttgacatgccgatgcacgcggcggaaacgtcgcggccttcgagggttcggcacaggtgctgcatggttgtcgtcagctcgtgtcgtgagatgttgggttaagtcccgcaacgagcgcaacccctgccggtagttatacgtgtctaccgggacagccgccttgatgggcggaggaaggcggggatgacgtcaaatcagcatggcccttacgcctggggcgacacacacgctacaatggccgggacagtgcgtcgcgaagccgcgaggtggagcaaatcgcccaaacccggtcccagtgcagatcgggggctgcaactcgcccccgtgaagtcggagttgctagtaaccgcgtatcagccacggcgcggtgaatacgttcccgggccttgtacacaccgcccgtcacgtcatgggagtggccaatgcttgaagtccgtgagctaacccgcaagggaggcagcggccgagggcaggggtcgcgactgggacgaagtcgtaacaag

SEQ ID NO: 6264 - DNA, 1540 bp, Ottowia oryzae
  ref <308>: DATABASE ACCESSION NUMBER: NCBI ACCESSION: NZ_CP027666.1
  ref <309>: DATABASE ENTRY DATE: 2019-04-01
  ref <313>: RELEVANT RESIDUES IN SEQ ID NO: (1)..(1540)
gaactgtagagtttgatcctggctcagattgaacgctggcggaatgctttacacatgcaagtcgaacggcagcacaggtgcttgcacctggtggcgagtggcgaacgggtgagtaatacatcggaacgtgcccagacgtgggggatagctcggcgaaagccgaattaataccgcatacgatctacggatgaaagcgggggatcgcaagacctcgcgcgtttggagcggccgatggcagattaggttgttggtggggtaaaggcttaccaagcctgcgatctgtagctggtctgagaggacgaccagccacactgggactgagacacggcccagactcctacgggaggcagcagtggggaattttggacaatgggcgaaagcctgatccagccattccgcgtgcaggatgaaggccctcgggttgtaaactgcttttgtacggaacgaaaagctctcttctaatacaggagggtcatgacggtaccgtaagaataagcaccggctaactacgtgccagcagccgcggtaatacgtagggtgcaagcgttaatcggaattactgggcgtaaagcgtgcgcaggcggttttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaattcattttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtttctagagatagattcgtgctcgaaagagagccgtaacacaggtgctgcatggctgtcgtcagctcgtgtcgtgagatgttgggttaagtcccgcaacgagcgcaacccttgccattagttgctacatttagttgggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtggttagcctaaccgtaaggagggcgatcaccacggcagggttcgtgactggggtgaagtcgtaacaaggtagccgtatcggaaggtgcggctggatcacctcctttctg

SEQ ID NO: 6265 - DNA, 1526 bp, Owenweeksia hongkongensis
  ref <308>: DATABASE ACCESSION NUMBER: NCBI ACCESSION: NC_016599.1
  ref <309>: DATABASE ENTRY DATE: 2019-04-01
  ref <313>: RELEVANT RESIDUES IN SEQ ID NO: (1)..(1526)
tacaatggagagtttgatcctggctcaggatgaacgctagcggcaggcttaacacatgcaagtcgaacggtaacaggtccttcgggatgctgacgagtggcgcacgggtgcgtaacgcgtatgcaatctacccctatcaggaggatagcccagagaaatttggattaatactccataatattatgagatcacatgttcttataattaaagcttcggtggatagggatgagcatgcgtcctattagctagttggtagtgtaacggactaccaaggcaacgataggtagggggcctgagagggtgatcccccacactggtactgagacacggaccagactcctacgggaggcagcagtgaggaatattggtcaatggacgaaagtctgaaccagccatgccgcgtgcaggatgacggccctatgggttgtaaactgcttttatatgggaataaaccctcggacgtgtccgaggctgaaggtaccataagaataaggaccggctaactccgtgccagcagccgcggtaatacggagggtccaagcgttatccggatttattgggtttaaagggtccgtaggcgggatattaagtcagtggtgaaagcctgcagcttaactgtagcactgccattgatactggtattcttgagtatagttgaagtgggcggaatatgtcatgtagcggtgaaatgcatagatatgacatagaacacctattgcgaaggcagctcactaagctatcactgacgctaagggacgaaagcgtgggtagcaaacaggattagataccctggtagtccacgccgtaaacgatgatcactcgctgttggcgatatacagtcagcggccaagcgaaagcattaagtgatccacctggggagtacgcgtcgcaagagtgaaactcaaaggaattgacgggggcccgcacaagcggtggagcatgtggtttaattcgatgatacgcgaggaaccttacctgggcttaaatgtagattgacaggctgagaaatcagtttttcttcggacaatttacaaggtgctgcatggttgtcgtcagctcgtgccgtgaggtgtcgggttaagtcccataacgagcgcaacccctattcttagttgccagcgagtaatgtcggggactctaggaaaactgcccgcgcaagcggtgaggaaggtggggatgacgtcaaatcatcacggcccttacgtccagggccacacacgtgctacaatggtagtgacaaagggcagctacacagcgatgtgatgctaatctctaaacactatctcagttcggatcgcagtctgcaactcgactgcgtgaagctggaatcgctagtaatcgcgcatcagccatggcgcggtgaatacgttcccgggccttgtacacaccgcccgtcaagccatggaagctgggggtgcctgaagtcggtcaccgaaaggagctgcctagggtaaaactagtgactggggctaagtcgtaacaaggtagccgtaccggaaggtgcggctggaacacctccttttaga

SEQ ID NO: 6266 - DNA, 1305 bp, Oxobacter pfennigii
  ref <308>: DATABASE ACCESSION NUMBER: NCBI ACCESSION: NZ_LKET01000049.1
  ref <309>: DATABASE ENTRY DATE: 2019-04-01
  ref <313>: RELEVANT RESIDUES IN SEQ ID NO: (1)..(1305)
atccgctatgagatggacccgcggcccattagctagttggtgagatagcagcccaccaaggcgacgatgggtagccgatctgagaggatgaacggccacattggaactgagacacggtccagactcctacgggaggcagcagtggggaatattgcgcaatgggggaaaccctgacgcagcaacgccgcgtgagtgaagaaggccttcgggtcgtaaagctctttaatcagggatgataatgacagtacctgaggaataagccacggctaactacgtgccagcagccgcggtaatacgtaggtggcgagcgttgtccggaattactgggcgtaaagggtgcgtaggcggaaacttaagtcagatgtgaaagcccggggcttaacttcgggattgcatttgaaactgagtttctagagtgcaggagaggaaagcggaattcctagtgtagcggtgaaatgcgtagatattaggaagaacaccagtggcgaaggcggctttctggactgtaactgacgctgatgcacgaaagcgtggggagcaaacaggattagataccctggtagtccacgctgtaaacgatgagtgctaggtgtagggggtatcgacaccctctgtgccgcagcaaacgcaataagcactccgcctggggagtacggtcgcaagactaaaactcaaaggaattgacgggggcccgcacaagcagcggagcatgtggtttaattcgaagcaacgcgaagaaccttaccagggcttgacatctaacaaatccttcagagatgagggagtgcccttcggggaatgttaagacaggtggtgcatggttgtcgtcagctcgtgtcgtgagatgttgggttaagtcccgcaacgagcgcaacccttgtcattagttgctaacattaagttgagcactctaatgagactgccggggacaactcggaggaaggtggggatgacgtcaaatcatcatgccccttatgtcctgggctacacacgtgctacaatggctagaacaatgagaagcaaaactgcgaagtggagcaaatctaaaaaactagtcccagttcggattgatggctgcaacccgccatcatgaagccggagttgctagtaatcgcgaatcagcatgtcgcggtgaatacgttcccgggccttgtacacaccgcccgtcacaccatgagagtctgcaacacccgaagcctgtgagctaactatatgaggcagcagtcgaaggtggggccgatgattggggtgaagtcgtaacaaggtagccgtatcagaaggtgcggctggatcacctcctttcta

SEQ ID NO: 6267 - DNA, 1474 bp, Pacificibacter marinus
  ref <308>: DATABASE ACCESSION NUMBER: NCBI ACCESSION: NZ_FWFW01000026.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgcttcccttcggggaggagcggcggacgggttagtaacgcgtgggaatgtacccttctctatggaatagcctttggaaacgaagagtaataccatatacgcccttcgggggaaagatttatcggagaaggatcagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcacctgtgaagataatgacggtagcaggaaaagaaaccccggctaactccgtgccagcagccgcggtaatacggagggggttagcgttgttcggaattactgggcgtaaagcgtacgtaggcggattagtaagtaagaggtgaaatcccatggctcaaccatggaactgccttttaaactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcgggtagcatgctgctcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcggatcgtagagatactttccttcagttcggctggacaatgtacaggtgctgcatggctgtcgtcagctcgtgtcgtgagatgttcggttaagtccggcaacgagcgcaacctacatccttagttgccagcagttcggctgggcactctagggaaactgcccgtgataagcgggaggaaggtgtagatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 6268 - DNA, 1474 bp, Pacificibacter maritimus
  ref <308>: DATABASE ACCESSION NUMBER: NCBI ACCESSION: NZ_RKQK01000007.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgctttccttcgggaaggagcggcggacgggttagtaacgcgtgggaatgtacccttctctatggaatagcctttggaaacgaagagtaataccatatacgcccttcgggggaaagatttatcggagaaggatcagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcacctgtgaagataatgacggtagcaggaaaagaaaccccggctaactccgtgccagcagccgcggtaatacggagggggttagcgttgttcggaattactgggcgtaaagcgtacgtaggcggattagtaagttagaggtgaaatcccatggctcaaccatggaactgcctttaaaactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcggatcgtagagatactttccttcagttcggctggacaatgtacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 6269 - DNA, 1529 bp, Paenarthrobacter nitroguajacolicus
tcaacggagagtttgatcctggctcaggatgaacgctggcggcgtgcttaacacatgcaagtcgaacgatgatctccagcttgctggggggattagtggcgaacgggtgagtaacacgtgagtaacctgcccttgactctgggataagcctgggaaactgggtctaataccggatatgaccatctggcgcatgtcatggtggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcggctggatcacctcctttctaagga

SEQ ID NO: 6270 - DNA, 1529 bp, Paenarthrobacter nitroguajacolicus; identical to SEQ ID NO: 6269

SEQ ID NO: 6271 - DNA, 1534 bp, Paenarthrobacter ureafaciens
  ref <308>: DATABASE ACCESSION NUMBER: NCBI ACCESSION: NZ_SBHM01000007.1
  ref <309>: DATABASE ENTRY DATE: 2019-04-01
  ref <313>: RELEVANT RESIDUES IN SEQ ID NO: (1)..(1534)
aacggagagtttgatcctggctcaggatgaacgctggcggcgtgcttaacacatgcaagtcgaacgatgatccggtgcttgcgccggggattagtggcgaacgggtgagtaacacgtgagtaacctgcccttgactctgggataagcctgggaaactgggtctaataccggatatgacttctcatcgcatggtggggggtggaaagctttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagccctctttgggggtgacggtacttgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaaagacctggaaacaggtgccccgcttgcggccggtttacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcggctggatcacctcctttctaagga

SEQ ID NO: 6272 - DNA, 1534 bp, Paenarthrobacter ureafaciens
aacggagagtttgatcctggctcaggatgaacgctggcggcgtgcttaacacatgcaagtcgaacgatgatccggtgcttgcgccggggattagtggcgaacgggtgagtaacacgtgagtaacctgcccttgactctgggataagcctgggaaactgggtctaataccggatatgactcctcatcgcatggtggggggtggaaagctttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagccctctttgggggtgacggtacttgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaaagacctggaaacaggtgccccgcttgcggccggtttacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcggctggatcacctcctttctaagga

SEQ ID NO: 6273 - DNA, 1566 bp, Paenibacillaceae bacterium GAS479
  ref <308>: DATABASE ACCESSION NUMBER: NCBI ACCESSION: NZ_LT629764.1
  ref <309>: DATABASE ENTRY DATE: 2019-04-01
  ref <313>: RELEVANT RESIDUES IN SEQ ID NO: (1)..(1566)
cctttatggagagtttgatcctggctcaggacgaacgctggcggcgtgcctaatacatgcaagtcgagcggattgatgagggagcttgctcccgattcagttagcggcggacgggtgagtaacacgtaggcaacctgccctcaagactgggataaccttcggaaacggatgctaataccagataaacggtttctccacctggagagatcgagaaagacggagcaatctgttacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaacgggtagaggagtaactgcctttatcatgacggtacctgagaagaaagccccggctaactacgtgccagcagccgcggtaatacgtagggggcaagcgttgtccggaattattgggcgtaaagcgcgcgcaggcggctttgtaagtctggtgtttaatcttggggctcaaccccaagtcgcacgagaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttgaattcagttgccagcacatcatggtgggcactctgaattgactgccggtgacaaaccggaggaaggcggggatgacgtcaaatcatcatgccccttatgacctgggctacacacgtactacaatggccggtacaacgggccgcgaaaccgcgaggtggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6274 - DNA, 1567 bp, Paenibacillaceae bacterium SCSIO 06110
  ref <308>: DATABASE ACCESSION NUMBER: NCBI ACCESSION: NZ_QXJP01000055.1
  ref <309>: DATABASE ENTRY DATE: 2019-04-01
  ref <313>: RELEVANT RESIDUES IN SEQ ID NO: (1)..(1567)
tttttggagagtttgatcctggctcaggacgaacgctggcggcgtgcctaatacatgcaagtcgagcggggagatttacggaagccttcgggtggaagtaatgatcctagcggcggacgggtgagtaacacgtaggtaacctgcctgtaagattgggacaactggtggaaacatcagctaataccaaatagagcttattctcgcatgagaggaagcggaaagagggttctgccctcacttacagatggacctgcggcgcattagctagttggagaggtaacggctccccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagagaagagtagagaggaaatgctctacttgagacggtacctgagaagaaagccccggctaactacgtgccagcagccgcggtaatacgtagggggcaagcgttgtccggaattattgggcgtaaagcgcgcgcaggcggtgaaataagtttggtgtctaaactcggggctcaacctcgagacgcactgaaaactgtttgactagagtacagcagaggagagtggaattccacgtgtagcggtgaaatgcgtagagatgtggaggaacaccagtggcgaaggcgactctctgggcttgtactgacgctgaggcgcgaaagcgtggggagcaaacaggattagataccctggtagtccacgccgtaaacgatgaatgctaggtgttaggggggatagactccttagtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgatcgcagtagagatattgctttccttcgggacagaggagacaggtggtgcatggttgtcgtcagctcgtgtcgtgagatgttgggttaagtcccgcaacgagcgcaacccttaatcttagttgccagcattttggatgggcactctaggatgactgccggtgacaaaccggaggaaggtggggatgacgtcaaatcatcatgccccttatgacctgggctacacacgtactacaatggtcggtacaacgggcagcgaagccgcgaggtggagcgaatctcataaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtgaggtaaccatttggagccagccgcctaaggtggggtagatgattggggtgaagtcgtaacaaggtagccgtatcggaaggtgcggctggatcacctcctttctatggag

SEQ ID NO: 6275 - DNA, 434 bp, Paenibacillus algorifonticola
  ref <308>: DATABASE ACCESSION NUMBER: NCBI ACCESSION: NZ_FONN01000020.1
  ref <309>: DATABASE ENTRY DATE: 2019-04-01
  ref <313>: RELEVANT RESIDUES IN SEQ ID NO: (1)..(434)
tggagagtttgatcctggctcaggacgaacgctggcggcgtgcctaatacatgcaagtcgagcggaccaagtgtttccttcgggaaacacgttggttagcggcggacgggtgagtaacacgtaggtaacctgcccgtaagactgggataacattcggaaacgaatgctaataccggatacacaacttggtcgcatgatcggagttgggaaagacggagcaatctgtcacttacggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggat

SEQ ID NO: 6276 - DNA, 1555 bp, Paenibacillus alvei
  ref <308>: DATABASE ACCESSION NUMBER: NCBI ACCESSION: NZ_ATMT01000077.1
  ref <309>: DATABASE ENTRY DATE: 2019-04-01
  ref <313>: RELEVANT RESIDUES IN SEQ ID NO: (1)..(1555)
acggagagtttgatcctggctcaggacgaacgctggcggcgtgcctaatacatgcaagtcgagcggacttgatggagtgcttgcactcctgatggttagcggcggacgggtgagtaacacgtaggtaacctgcccataagactgggataacccacggaaacgtgagctaataccagataggcattttcctcgcatgagggagatgagaaaggcggagcaatctgccacttatggatggacctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcctaggagagtaactgctcttagggtgacggtacctgagaagaaagccccggctaactacgtgccagcagccgcggtaatacgtagggggcgagcgttgtccggaattattgggcgtaaagcgcgcgcaggcggcaatgtaagttgggtgtttaaacctagggctcaaccttgggtcgcatccaaaactgcatagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccgtcctagagatagggctttccttcgggacattcaagacaggtggtgcatggttgtcgtcagctcgtgtcgtgagatgttgggttaagtcccgcaacgagcgcaacccttaactttagttgccagcattcagttgggcactctagagtgactgccggtgacaaaccggaggaaggtggggatgacgtcaaatcatcatgccccttatgacctgggctacacacgtactacaatggtcggtacaacgggaagcgaagccgcgaggtggagccaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctaagga

SEQ ID NO: 6277 - DNA, 1565 bp, Paenibacillus antarcticus
  ref <308>: DATABASE ACCESSION NUMBER: NCBI ACCESSION: NZ_LVJI01000026.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagttgttttggaagcttgcttccaaaacaacttagcggcggacgggtgagtaacacgtaggtaacctgcctataagactgggataactaccggaaacggtagctaataccggataatttgtttcttctcatgaagaggcactgaaaggcggagtaatctgccacttatagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaatgccgcgtgagtgatgaaggttttcggatcgtaaagctctgttgccagggaagaatgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccgggtcgcactggaaactggatgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttatatttagttgccagcacattatggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6278 - DNA, 397 bp, Paenibacillus assamensis
  ref <308>: DATABASE ACCESSION NUMBER: NCBI ACCESSION: NZ_AULU01000022.1
  ref <309>: DATABASE ENTRY DATE: 2019-04-01
  ref <313>: RELEVANT RESIDUES IN SEQ ID NO: (1)..(397)
cttttatggagagtttgatcctggctcaggacgaacgctggcggcgtgcctaatacatgcaagtcgagcggacttgaaggagtgcttgcactcctgatgcctagcggcggacgggggagtaacacgtaggcaacctgcctgtaagactgggataactaccggaaacggtagctaataccagataggcttcttcctcacctgaggaagaagagaaagacggagcaatctgtcacttacagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagt

SEQ ID NO: 6279 - DNA, 531 bp, Paenibacillus barengoltzii
  ref <308>: DATABASE ACCESSION NUMBER: NCBI ACCESSION: NZ_FXAE01000055.1
  ref <309>: DATABASE ENTRY DATE: 2019-04-01
  ref <313>: RELEVANT RESIDUES IN SEQ ID NO: (1)..(531)
atccttattggagagtttgatcctggctcaggacgaacgctggcggcgtgcctaatacatgcaagtcgagcggacctgatggagtgcttgcactcctgatggttagcggcggacgggtgagtaacacgtaggcaacctgcctgtaagactgggataactaccggaaacggtagctaataccggatacgcaagtctatcgcatgagggacttgggaaagacggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccgttagagtaactgctaacggagtgacggtacctgagaagaaagccccggctaactacgtg

SEQ ID NO: 6280 - DNA, 1562 bp, Paenibacillus beijingensis
  ref <308>: DATABASE ACCESSION NUMBER: NCBI ACCESSION: NZ_CP011058.1
  ref <309>: DATABASE ENTRY DATE: 2019-04-01
  ref <313>: RELEVANT RESIDUES IN SEQ ID NO: (1)..(1562)
cttttatggagagtttgatcctggctcaggacgaacgctggcggcgtgcctaatacatgcaagtcgagcggacttgaagggagcttgctcctggatggttagcggcggacgggtgagtaacacgtaggcaacctgcctgtaagaccgggataaccttcggaaacgaaagctaataccggataagcggttcctttgcatagaggaaccgggaaagacggcgcaagctgtcacttgcagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaatgtcgcggagagtaactgctctgcgaatgacggtacctgagaagaaagccccggctaactacgtgccagcagccgcggtaatacgtagggggcaagcgttgtccggaattattgggcgtaaagcgcgcgcaggcggctttgtaagtctggtgtttaaccctcgggctcaacctgaggtcgcatcggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacagtaagcattccgcctggggagtacgctcgcaagagtgaaactcaaaggaattgacggggacccgcacaagcagtggagtatgtggtttaattcgaagcaacgcgaagaaccttaccaggtcttgacatccccctgaatccgctagagatagcggcggccttcgggacaggggagacaggtggtgcatggttgtcgtcagctcgtgtcgtgagatgttgggttaagtcccgcaacgagcgcaacccttaggttcagttgccagcacgtagtggtgggcactctgaaacgactgccggtgacaaaccggaggaaggtggggatgacgtcaaatcatcatgccccttatgacctgggctacacacgtactacaatggccggtacaacgggccgcgaagccgcgaggcggagccaatcctataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggaga

SEQ ID NO: 6281 - DNA, 1563 bp, Paenibacillus borealis
  ref <308>: DATABASE ACCESSION NUMBER: NCBI ACCESSION: NZ_MPTB01000068.1
  ref <309>: DATABASE ENTRY DATE: 2019-04-01
  ref <313>: RELEVANT RESIDUES IN SEQ ID NO: (1)..(1563)
tttggagagtttgatcctggctcaggacgaacgctggcggcgtgcctaatacatgcaagtcgagcggagttatgaaggagcttgctccggattaacttagcggcggacgggtgagtaacacgtaggcaacctacctctttgactgggataactaccggaaacggtagctaataccggataattcctttgttcacatggacgaaggatgaaaggcggagcaatctgctacaaggagatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccattagagatagtggcggccttcgggacagaggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6282 - DNA, 1472 bp, Paenibacillus camerounensis
  ref <308>: DATABASE ACCESSION NUMBER: NCBI ACCESSION: NZ_CCDG010000111.1
  ref <309>: DATABASE ENTRY DATE: 2019-04-01
  ref <313>: RELEVANT RESIDUES IN SEQ ID NO: (1)..(1472)
taagcttagcggcggacgggtgagtaacacgtaggcaacctgccccttaacctgggataactaccggaaacggtagctaataccggataatttcttttttctcctgagaagagaatgaaaggcggagcaatctgtcattaagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccggtgtaagcattagagatagtgcccctcttcggagcatcggagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccagtacaacgggaagcgaagccgcgaggtggagccaatcccagcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6283 - DNA, 1567 bp, Paenibacillus crassostreae
  ref <308>: DATABASE ACCESSION NUMBER: NCBI ACCESSION: NZ_CP017770.1
  ref <309>: DATABASE ENTRY DATE: 2019-04-01
  ref <313>: RELEVANT RESIDUES IN SEQ ID NO: (1)..(1567)
cttatatggagagtttgatcctggctcaggacgaacgctggcggcgtgcctaatacatgcaagtcgagcggagtgatttgaaagcttgctttcaaatcacttagcggcggacgggtgagtaacacgtaggtaacctgcctgtaagactgggataactaccggaaacggtagctaataccggataacttgtttcctctcctggggagacactgaaaggcggagtaatctgccacttacagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtttggtgtttaattccagggctcaaccctgggtcgcactgaaaactgggtgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttatgcttagttgccagcacattatggtgggcactctaagcagactgccggtgacaaaccggaggaaggtggggatgacgtcaaatcatcatgccccttatgacctgggctacacacgtactacaatggccagtacaacgggctgcgaaaccgcgaggtggagccaatcccaacaaagctggtctcagttcggattgtaggctgcaacccgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6284 - DNA, 207 bp, Paenibacillus daejeonensis
  ref <308>: DATABASE ACCESSION NUMBER: NCBI ACCESSION: NZ_KB899668.1
  ref <309>: DATABASE ENTRY DATE: 2019-04-01
  ref <313>: RELEVANT RESIDUES IN SEQ ID NO: (1)..(207)
ctatcatggagagtttgatcctggctcaggacgaacgctggcggcgtgcctaatacatgcaagtcgagcggacttgatgagaagcttgcttctctgatagttagcggcggacgggtgagtaacacgtaggcaacctgcctgcaagcctgggataactgcgggaaaccgcagctaataccggatacgcagtcgagatgcatatcttga

SEQ ID NO: 6285 - DNA, 1144 bp, Paenibacillus dauci
  ref <308>: DATABASE ACCESSION NUMBER: NCBI ACCESSION: NZ_KQ040802.1
  ref <309>: DATABASE ENTRY DATE: 2019-04-01
  ref <313>: RELEVANT RESIDUES IN SEQ ID NO: (1)..(1144)
tttatggagagtttgatcctggctcaggacgaacgctggcggcgtgcctaatacatgcaagtcgagcggagtcgatagaaagcttgctttcttgagacttagcggcggacgggtgagtaacacgtaggcaacctgcccctcagactgggataactaccggaaacggtagctaataccggataatcgttttcttctcctgaagagaccgggaaagacggagcaatctgtcactgagggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcgggtagagtaactgctatccgagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccgaagctcaacttcgggtcgcatcggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatgcttagttgccagcac

SEQ ID NO: 6286 - DNA, 1566 bp, Paenibacillus durus
  ref <308>: DATABASE ACCESSION NUMBER: NCBI ACCESSION: NZ_CP011114.1
  ref <309>: DATABASE ENTRY DATE: 2019-04-01
  ref <313>: RELEVANT RESIDUES IN SEQ ID NO: (1)..(1566)
tttattggagagtttgatcctggctcaggacgaacgctggcggcgtgcctaatacatgcaagtcgagcggagttgtgatggagcttgctcctaatcaacttagcggcggacgggtgagtaacacgtaggcaacctgccccttggactgggataactaccggaaacggtagctaataccggataattcctcttagctcctgctaggaggctgaaaggcggagcaatctgtcaccaagggatgggcctgcggcgcattagctagttggtggggtaacggctcaccaaggcgacgatgcgtagccgacctgaggagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccttaagagtaactgcttaaggagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactggacagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatacgttagagatagcgtaggccttcgggacagaggagacaggtggtgcatggttgtcgtcagctcgtgtcgtgagatgttgggttaagtcccgcaacgagcgcaacccttgactttagttgccagcaggtggtgctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcttataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgtaagggagccagccgccgaaggtggggtagatgattggggtgaagtcgtaacaaggtagccgtatcggaaggtgcggctggatcacctcctttctatggaga

SEQ ID NO: 6287 - DNA, 785 bp, Paenibacillus etheri
  ref <308>: DATABASE ACCESSION NUMBER: NCBI ACCESSION: NZ_LCZJ02000075.1
  ref <309>: DATABASE ENTRY DATE: 2019-04-01
  ref <313>: RELEVANT RESIDUES IN SEQ ID NO: (1)..(785)
agggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctaaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatc

SEQ ID NO: 6288 - DNA, 1273 bp, Paenibacillus ferrarius
  misc_feature (228)..(228): n is a, c, g, or t
  ref <308>: DATABASE ACCESSION NUMBER: NCBI ACCESSION: NZ_MBTG01000042.1
  ref <309>: DATABASE ENTRY DATE: 2019-04-01
  ref <313>: RELEVANT RESIDUES IN SEQ ID NO: (1)..(1273)
ctactatggagagtttgatcctggctcaggacgaacgctggcggcgtgcctaatacatgcaagtcgagcggagtatttccttcggggaatgcttagcggcggacgggtgagtaacacgtaggtaacctgcctatcagatcgggataactatcggaaacgatagctaagaccggataactggttttctcgcatgagagaattatgaaacacggagcaatctgtggctgntagatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcatgaggagtaactgccttgtgtgtgacggtataggagaagaaagccccggctaactacgtgccagcagccgcggtaatacgtagggggcaagcgttgtccggaattattgggcgtaaagcgcgcgcaggcggttaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgtcggggattcgatttctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatcccaatgtaacgcctagagataggcgccctcttcggagcattggagacaggtggtgcatggttgtcgtcagctcgtgtcgtgagatgttgggttaagtcccgcaacgagcgcaacccttgatcttagttgccagcacttcgggtgggcactctaagatgactgccggtgacaaaccggaggaaggtggggatgacgtcaaatcatcatgccccttatgacctgggctacacacgtactacaatggtcggtacaacgggaagcgaagccgcgagg

SEQ ID NO: 6289 - DNA, 206 bp, Paenibacillus fonticola
  ref <308>: DATABASE ACCESSION NUMBER: NCBI ACCESSION: NZ_KB907269.1
  ref <309>: DATABASE ENTRY DATE: 2019-04-01
  ref <313>: RELEVANT RESIDUES IN SEQ ID NO: (1)..(206)
tttattggagagtttgatcctggctcaggacgaacgctggcggcgtgcctaatacatgcaagtcgagcgaggttattttggaagcttgcttccgaaatcacctagcggcggacgggtgagtaatacgtaggcaacctgcccctatgctcgggataactagcggaaacgttagctaataccggataatttgctttctcgcatgaggg

SEQ ID NO: 6290 - DNA, 976 bp, Paenibacillus forsythiae
  ref <308>: DATABASE ACCESSION NUMBER: NCBI ACCESSION: NZ_ASSC01000211.1
  ref <309>: DATABASE ENTRY DATE: 2019-04-01
  ref <313>: RELEVANT RESIDUES IN SEQ ID NO: (1)..(976)
agagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactggacagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggatcagagatgatcctttccttcgggacagaggagacaggtggtgcatggttgtcgtcagctcgtgtcgtgagatgttgggttaagtcccgcaacgagcgcaacccttgactttagttgccagcaggtaaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcttataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccc

SEQ ID NO: 6291 - DNA, 301 bp, Paenibacillus ginsengihumi
  ref <308>: DATABASE ACCESSION NUMBER: NCBI ACCESSION: NZ_KB905565.1
  ref <309>: DATABASE ENTRY DATE: 2019-04-01
  ref <313>: RELEVANT RESIDUES IN SEQ ID NO: (1)..(301)
atcctttttggagagtttgatcctggctcaggacgaacgctggcggcgtgcctaatacatgcaagtcgagcgctggatgatttccttcggggaattatccggagcggcggacgggggagtaacacgtaggcaacctgcccggaagaccgggataactaccggaaacggtagctaataccggataggtggcttcttcgcatgggggagccaagaaacgcggagcaatctgcggcttacggatgggcctgcggcgcattagctagttggcagggtaacggcctaccaaggcgacgatgcgtag

SEQ ID NO: 6292 - DNA, 1563 bp, Paenibacillus glacialis
  ref <308>: DATABASE ACCESSION NUMBER: NCBI ACCESSION: NZ_LVJH01000032.1
  ref <309>: DATABASE ENTRY DATE: 2019-04-01
  ref <313>: RELEVANT RESIDUES IN SEQ ID NO: (1)..(1563)
tggggagttggtgccgggctcaggacgaacgctggcggcatgcctaatacatgcaagtcgagcggagttgttttggaagcttgcttccaaaacaacttagcggcggacgggtgagtaacacgtaggtaacctgcctataagactgggataactaccggaaacggtagctaataccggataatttgtttcttctcatgaagagacactgaaaggcggagtaatctgccacttatagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcctggggctcaaccccaggtcgcactggaaactggatgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttatgcttagttgccagcacattatggtgggcactctaagcagactgccggtgacaaaccggaggaaggtggggatgacgtcaaatcatcatgccccttatgacctgggctacacacgtactacaatggccggtacaacgggctgcgaaatcgcgagatggagccaatcccaccaaagccggtctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6293 - DNA, 1484 bp, Paenibacillus gorillae
  ref <308>: DATABASE ACCESSION NUMBER: NCBI ACCESSION: NZ_CBVJ010000152.1
  ref <309>: DATABASE ENTRY DATE: 2019-04-01
  ref <313>: RELEVANT RESIDUES IN SEQ ID NO: (1)..(1484)
gaagtgcttgcacttctgatggttagcggcggacgggtgagtaacacgtgggtaacctgcccataagactgggataacattcggaaacgaatgctaataccggatacgcggtttggtcgcatggccgaaccgggaaagacggagcaatctgtcacttatggatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctatggagagtaactgctccataggtgacggtacctgagaagaaagccccggctaactacgtgccagcagccgcggtaatacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccgtcctagagatagggctttccttcgggacaaaggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 6294 - DNA, 1566 bp, Paenibacillus graminis
  ref <308>: DATABASE ACCESSION NUMBER: NCBI ACCESSION: NZ_CP009287.1
  ref <309>: DATABASE ENTRY DATE: 2019-04-01
  ref <313>: RELEVANT RESIDUES IN SEQ ID NO: (1)..(1566)
tttggagagtttgatcctggctcaggacgaacgctggcggcgtgcctaatacatgcaagtcgagcggatttactggagtgcttgcactccagtaggttagcggcggacgggtgagtaacacgtaggcaacctaccctctagactgggataactaccggaaacggtagctaataccggataattccctgacccccctgggctagggatgaaaggcggagcaatctgctgctagaggatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 6295 - DNA, 303 bp, Paenibacillus harenae
  ref <308>: DATABASE ACCESSION NUMBER: NCBI ACCESSION: NZ_AULV01000013.1
  ref <309>: DATABASE ENTRY DATE: 2019-04-01
  ref <313>: RELEVANT RESIDUES IN SEQ ID NO: (1)..(303)
tggagagtttgatcctggctcaggacgaacgctggcggcgtgcctaatacatgcaagtcgagcggagttattccttcgggagtgacttagcggcggacgggtgagtaacacgtaggtaacctgcctgtaagaccgggataacattcggaaacgaatgctaataccggatacgcaatctggtcgcatgaccggattgggaaagacggagcaatctgtcgcttatagatggacctgcggcgcattagctagttggtgaggtaacggctcaccaaggcgacgatgcgtagccgacctgagagggtg

SEQ ID NO: 6296 - DNA, 1565 bp, Paenibacillus ihumii
  ref <308>: DATABASE ACCESSION NUMBER: NCBI ACCESSION: NZ_LN884296.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcggggttgttttggaagcttgcttccgaaccaacctagcggcggacgggtgagtaatacgtaggcaacctgcccctcagcctgggataactagcggaaacgttagctaataccggataatttgcttcatcgcatgaagaagcaatgaaagacggagcaatctgtcactaagggatgggcctacggcgcattagctagttggtagggtaatggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtcttggagagtaactgctctaagagtgacggtacctgagaagaaagccccggctaactacgtgccagcagccgcggtaatacgtagggggcaagcgttgtccggaattattgggcgtaaagcgcgcgcaggcggccatttaagtctggtgtttaatcccggggctcaactccgggtcgcactggaaactgggtggcttgagtgcagaagaggagagtggaattccacgtgtagcggtgaaatgcgtagagatgtggaggaacaccagtggcgaaggcgactctctgggctgtaactgacgctgaggcgcgaaagcgtgggtagcaaacaggattagataccctggtagtccacgccgtaaacgatgaatgctaggtgttaggggtttcgatacccttggtgccgaagtaaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgacccctctagagatagaggtttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccagtacaacgggaagcgaaaccgcgaggtggagcgaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggaga

SEQ ID NO: 6297 - DNA, 496 bp, Paenibacillus jilunlii
  ref <308>: DATABASE ACCESSION NUMBER: NCBI ACCESSION: NZ_FNGM01000031.1
  ref <309>: DATABASE ENTRY DATE: 2019-04-01
  ref <313>: RELEVANT RESIDUES IN SEQ ID NO: (1)..(496)
tttggagagtttgatcctggctcaggacgaacgctggcggcgtgcctaatacatgcaagtcgagcggagtcttgttggaagcttgcttccaacctggcttagcggcggacgggtgagtaacacgtaggcaacctaccctctagactgggataactaccggaaacggtagctaataccggataattccttgaccctcatgggtttgggatgaaaggcggagcaatctgctgctagaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctgccggagtgacggt

SEQ ID NO: 6298 - DNA, 1565 bp, Paenibacillus macquariensis
  ref <308>: DATABASE ACCESSION NUMBER: NCBI ACCESSION: NZ_FTNK01000072.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagttgttttgaaagcttgctttcaaaacaacttagcggcggacgggtgagtaacacgtaggtaacctgcctgtaagactgggataactaccggaaacggtagctaataccggataatttgtttcttctcatgaagagacactgaaaggcggagtaatctgccacttatagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccgggtcgcactggaaactggatgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttatatttagttgccagcacattatggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaccaaagccggtctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6299 - DNA, 917 bp, Paenibacillus massiliensis
  ref <308>: DATABASE ACCESSION NUMBER: NCBI ACCESSION: NZ_ASSE01000174.1
  ref <309>: DATABASE ENTRY DATE: 2019-04-01
  ref <313>: RELEVANT RESIDUES IN SEQ ID NO: (1)..(917)
gagtaacacgtaggcaacctgccctctggactgggataactaccggaaacggtagctaataccagataattcacttcttcgcatggagaagtgaggaaagacggagcaatctgtcaccggaggatgggcctgcggcgcattagctagttggagaggtaacggctccccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtccttaagagtaactgcttaaggagtgacggtacttgagaagaaagccccggctaactacgtgccagcagccgcggtaatacgtagggggcaagcgttgtccggaattattgggcgtaaagcgcgcgcaggcggtcatttaagtctggtgtttaagcccggggctcaaccccggatcgcacgggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatctgaatgaccggtacagagatgta

SEQ ID NO: 6300 - DNA, 1546 bp, Paenibacillus mucilaginosus
  ref <308>: DATABASE ACCESSION NUMBER: NCBI ACCESSION: NC_017672.3
  ref <309>: DATABASE ENTRY DATE: 2019-04-01
  ref <313>: RELEVANT RESIDUES IN SEQ ID NO: (1)..(1546)
tttattggagagtttgatcctggctcaggacgaacgctggcggcgtgcctaatacatgcaagtcgagcggagcacttcggtgcttagcggcggacgggtgagtaacacgtaggcaacctgcctgtaagatcgggataactaccggaaacggtagctaagaccggatagctggtttcggtgcatgccggaatcatgaaacatggggcaacctgtggcttacggatgggcctgcggcgcattagctagttggcggggtaacggcccaccaaggcgacgatgcgtagccgacctgagagggtgatcggccacactgggactgagacacggcccagactcctacgggaggcagcagtagggaatcttccgcaatgggcgcaagcctgacggagcaacgccgcgtgagtgatgaaggttttcggatcgtaaagctctgttgccagggaagaatgtcgtggagagtaactgctctgcgaatgacggtacctgagaagaaagccccggctaactacgtgccagcagccgcggtaatacgtagggggcaagcgttgtccggaattattgggcgtaaagcgcgcgcaggcggtcttttaagtctggtgtttaagcccggggctcaaccccggttcgcaccggaaactggaagacttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacaggattagataccctggtagtccacgccgtaaacgatgagtgctaggtgttaggggtttcgatacccttggtgccgaagtaaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctctgaaagccctagagatagggtcctccttcgggacagaggtgacaggtggtgcatggttgtcgtcagctcgtgtcgtgagatgttgggttaagtcccgcaacgagcgcaacccttgactttagttgccagcattgagttgggcactctagagtgactgccggtgacaaaccggaggaaggtggggatgacgtcaaatcatcatgccccttatgacctgggctacacacgtactacaatggccggtacaacgggaagcgaagtcgcgagatggagcgaatccttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggggccagccgtcgaaggtggggtagatgattggggtgaagtcgtaacaaggtagccgtatcggaaggtgcggctggatcacctcctttctatggag

SEQ ID NO: 6301 - DNA, 1464 bp, Paenibacillus naphthalenovorans
  ref <308>: DATABASE ACCESSION NUMBER: NCBI ACCESSION: NZ_FNDY01000090.1
  ref <309>: DATABASE ENTRY DATE: 2019-04-01
  ref <313>: RELEVANT RESIDUES IN SEQ ID NO: (1)..(1464)
cctggagcggcggacgggtgagtaacacgtaggcaacctgcctgtaagaccgggataactaccggaaacggtagctaagaccggataggtggtttctccgcatggagggatcaagaaacacggtgcaagctgtggcttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaagaaggttttcggatcgtaaagctctgttgccaaggaagaacgccttggggagtcactgccctgagggtgacggtacttgagaagaaagccccggctaactacgtgccagcagccgcggtaatacgtagggggcaagcgttgtccggaattattgggcgtaaagcgcgcgcaggcggccgcttaagtttggtgtataagcccggggctcaaccccggatcgcaccgaaaactgggtggcttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacaggattagataccctggtagtccacgccgtaaacgatgagtgctaggtgttaggggtttcgatacccttggtgccgaagtcaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctttgaccggtacagagatgtacctttccttcgggacagaggagacaggtggtgcatggttgtcgtcagctcgtgtcgtgagatgttgggttaagtcccgcaacgagcgcaacccttgagcttagttgccagcattaagttgggcactctaagttgactgccggtgacaaaccggaggaaggtggggatgacgtcaaatcatcatgccccttatgacctgggctacacacgtactacaatggccggtacaacgggaagcgaaggagcgatccggagcgaatccttataagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggag

SEQ ID NO: 6302 - DNA, 541 bp, Paenibacillus oryzae
  ref <308>: DATABASE ACCESSION NUMBER: NCBI ACCESSION: NZ_LYPA01000036.1
  ref <309>: DATABASE ENTRY DATE: 2019-04-01
  ref <313>: RELEVANT RESIDUES IN SEQ ID NO: (1)..(541)
aggagagtaactgctcctggtttgacggtacctgagaagaaagccccggctaactacgtgccagcagccgcggtaatacgtagggggcaagcgttgtccggaattattgggcgtaaagcgcgcgcaggcggtttggaaagtctggtgtttaaggctgaggctcaacctcagttcgcactggaaactgtcagacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 6303 - DNA, 276 bp, Paenibacillus panacisoli
  ref <308>: DATABASE ACCESSION NUMBER: NCBI ACCESSION: NZ_AUFO01000011.1
  ref <309>: DATABASE ENTRY DATE: 2019-04-01
  ref <313>: RELEVANT RESIDUES IN SEQ ID NO: (1)..(276)
tttattggagagtttgatcctggctcaggacgaacgctggcggcgtgcctaatacatgcaagtcgagcggacttgatggagagcttgctctcctgagagttagcggcggacgggtgagtaacacgtaggcaacctgccctctggactgggataactaccggaaacggtagctaataccagataattcacttcttcgcatggagaagtgaggaaagacggagcaatctgtcaccggaggatgggcctgcggcgcattagctagttggagaggtaacg

SEQ ID NO: 6304 - DNA, 622 bp, Paenibacillus pectinilyticus
  ref <308>: DATABASE ACCESSION NUMBER: NCBI ACCESSION: NZ_LYPC01000004.1
  ref <309>: DATABASE ENTRY DATE: 2019-04-01
  ref <313>: RELEVANT RESIDUES IN SEQ ID NO: (1)..(622)
aatctgtggcttagagatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcatgaggagtaactgccttgtgtgtgacggtataggagaagaaagccccggctaactacgtgccagcagccgcggtaatacgtagggggcaagcgttgtccggaattattgggcgtaaagcgcgcgcaggcggtcatttaagtctggtgtttaatcctggggctcaaccccagttcgcatcggaaactggatgacttgagtgtaagagaggaaagtggaattccacgtgtagcggtgaaatgcgtagagatgtggaggaacaccagtggcgaaggcgactttctggcttataactgacgctgaggcgcgaaagcgtggggagcaaacaggattagataccctggtagtccacgccgtaaacgatgcatactaggtgtc

SEQ ID NO: 6305 - DNA, 1363 bp, Paenibacillus pini
  ref <308>: DATABASE ACCESSION NUMBER: NCBI ACCESSION: NZ_BAZT01000055.1
  ref <309>: DATABASE ENTRY DATE: 2019-04-01
  ref <313>: RELEVANT RESIDUES IN SEQ ID NO: (1)..(1363)
ggagatgatgaaagatggagcaatctatcacttacagatgggcctgcggcgcattagctagttggtggggtaatggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctgtttaagtctggtgtttaatcctggggctcaaccccgggtcgcactggaaactggacagcttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatcccgatgcaaacactagagatagtgtccttcttcggaacatcggagacaggtggtgcatggttgtcgtcagctcgtgtcgtgagatgttgggttaagtcccgcaacgagcgcaacccttgattttagttgccagcacttcggtgggcactctagaatgactgccggtgacaaaccggaggaaggcggggatgacgtcaaatcatcatgccccttatgacctgggctacacacgtactacaatggtcgatacaacgggtagcgaaggagcgatctggagccaatcctatcaaagtcgatctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6306 - DNA, 1563 bp, Paenibacillus rhizosphaerae
  ref <308>: DATABASE ACCESSION NUMBER: NCBI ACCESSION: NZ_MRTP01000012.1
  ref <309>: DATABASE ENTRY DATE: 2019-04-01
  ref <313>: RELEVANT RESIDUES IN SEQ ID NO: (1)..(1563)
tttcttggagagtttgatcctggctcaggacgaacgctggcggcgtgcctaatacatgcaagtcgagcggacttgatggagagcttgctctcctgatagttagcggcggacgggtgagtaacacgtaggcaacctgcctgcaagaccgggataacccacggaaacgtgagctaataccggatatctcatttcctctcctgaggggatgatgaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctgatagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacctgggctacacacgtactacaatggccagtacaacgggaagcgaagccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 6307 - DNA, 1569 bp, Paenibacillus sabinae
  ref <308>: DATABASE ACCESSION NUMBER: NCBI ACCESSION: NZ_CP004078.1
  ref <309>: DATABASE ENTRY DATE: 2019-04-01
  ref <313>: RELEVANT RESIDUES IN SEQ ID NO: (1)..(1569)
ccttttttggagagtttgatcctggctcaggacgaacgctggcggcgtgcctaatacatgcaagtcgagcggagtattttgaagagcttgctcttcaaaatacttagcggcggacgggtgagtaacacgtaggcaacctgccccttggactgggataactaccggaaacggtagctaataccggataagaccttctggtgcataccggaaggcggaaaggcggagcaatctgtcaccaggggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcttagagtaactgctaagagagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactgggcagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcacctagagataggtgcggccttcgggacaaaggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcttataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6308 - DNA, 1294 bp, Paenibacillus selenitireducens
  ref <308>: DATABASE ACCESSION NUMBER: NCBI ACCESSION: NZ_MSZX01000035.1
  ref <309>: DATABASE ENTRY DATE: 2019-04-01
  ref <313>: RELEVANT RESIDUES IN SEQ ID NO: (1)..(1294)
ggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgctatggagagtaactgctctgtaggtgacggtacctgagaagaaagccccggctaactacgtgccagcagccgcggtaatacgtagggggcaagcgttgtccggaattattgggcgtaaagcgcgcgcaggcggctttgtaagtctggtgtttaaacctagggctcaaccctgggtcgcattggaaactgcaaggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatcccgatgaaagctctagagatagagcccctcttcggagcattggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggtcgatacaacgggaagcgaagccgcgaggtggagccaatcctatcaaagtcgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctatggaga

SEQ ID NO: 6309 - DNA, 897 bp, Paenibacillus sp. 1-18
  ref <308>: DATABASE ACCESSION NUMBER: NCBI ACCESSION: NZ_ASSB01000329.1
  ref <309>: DATABASE ENTRY DATE: 2019-04-01
  ref <313>: RELEVANT RESIDUES IN SEQ ID NO: (1)..(897)
aacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtcgggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctga

SEQ ID NO: 6310 - DNA, 1112 bp, Paenibacillus sp. 1-49
  ref <308>: DATABASE ACCESSION NUMBER: NCBI ACCESSION: NZ_ASRY01000111.1
  ref <309>: DATABASE ENTRY DATE: 2019-04-01
  ref <313>: RELEVANT RESIDUES IN SEQ ID NO: (1)..(1112)
gagtaacacgtaggcaacctgcccatgagactgggataactaccggaaacggtagctaataccggatacatcctttccctgcatggggaggggaggaaagacggagcaatctgtcactgatggatgggcctgcggcgcattagctagttggtggggtaatggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagatagacctttccttcgggacaggggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatg

SEQ ID NO: 6311 - DNA, 529 bp, Paenibacillus sp. 1ZS3-15
  ref <308>: DATABASE ACCESSION NUMBER: NCBI ACCESSION: NZ_LYPB01000004.1
  ref <309>: DATABASE ENTRY DATE: 2019-04-01
  ref <313>: RELEVANT RESIDUES IN SEQ ID NO: (1)..(529)
aagactgggataactatcggaaacgatagctaagaccggataactggtactctcgcatgagagaatcataaaacacggagcaatctgtggcttgaagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaaggagagtaactgctctttgtgtgacggtataggagaagaaagccccggctaactacgtgccagcagccgcggtaatacgtagggggcaagcgttgtccggaattattgggcgtaaagcgcgcgcaggcggtcatttaagtctggtgtttaagcccggggctcaaccccggttcgcatcggaaactggatgacttgagtgta

SEQ ID NO: 6312 - DNA, 1516 bp, Paenibacillus sp. 32352
  ref <308>: DATABASE ACCESSION NUMBER: NCBI ACCESSION: NZ_MZNT01000021.1
  ref <309>: DATABASE ENTRY DATE: 2019-04-01
  ref <313>: RELEVANT RESIDUES IN SEQ ID NO: (1)..(1516)
tggagagtttgatcctggctcaggacgaacgctggcggcgtgcctaatacatgcaagtcgagcggtcccttcggggatagcggcggacgggtgagtaacacgtaggcaacctgcctgtaagatcgggataactatcggaaacgatagctaagaccggatagctggttctctcgcatgagggaatcatgaaacacggggcaacctgtggcttacagatgggcctgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccttggagagtaactgctctgagggtgacggtacctgagaagaaagccccggctaactacgtgccagcagccgcggtaatacgtagggggcaagcgttgtccggaattattgggcgtaaagcgcgcgcaggcggtcatttaagtttggtgtttaagcccggggctcaaccccggatcgcactgaaaactgggtgacttgagtgcgggagaggaaagtggaattccacgtgtagcggtgaaatgcgtagagatgtggaggaacaccagtggcgaaggcgactttctggaccgtaactgacgctgaggcgcgaaagcgtggggagcaaacaggattagataccctggtagtccacgccgtaaacgatgagtgctaggtgttaggggtttcgatacccttggtgccgaagtcaacacagtaagcactccgcctggggagtacgctcgcaagagtgaaactcaaaggaattgacggggacccgcacaagcagtggagtatgtggtttaattcgaagcaacgcgaagaaccttaccaggtcttgacatcccgatgaaacacctagagataggtgccctcttcggagcattggagacaggtggtgcatggttgtcgtcagctcgtgtcgtgagatgttgggttaagtcccgcaacgagcgcaacccttgactttagttgccagcattgagttgggcactctagagtgactgccggtgacaaaccggaggaaggcggggatgacgtcaaatcatcatgccccttatgacctgggctacacacgtactacaatggccggtacaacgggaagcgaagccgcgaggtggagccaatccttacaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctg

SEQ ID NO: 6313 - DNA, 1562 bp, Paenibacillus sp. 32O-W
  ref <308>: DATABASE ACCESSION NUMBER: NCBI ACCESSION: NZ_CP013653.1
  ref <309>: DATABASE ENTRY DATE: 2019-04-01
  ref <313>: RELEVANT RESIDUES IN SEQ ID NO: (1)..(1562)
tttatggagagtttgatcctggctcaggacgaacgctggcggcgtgcctaatacatgcaagtcgagcggagctgaggagaagcttgcttctctgaagcttagcggcggacgggtgagtaacacgtaggcaacctgcctgcaagaccgggataactgacggaaacgtgagctaataccggataggcggacttctcgcatgaggggttcgggaaaggcggcgcaagctgtcacttgcagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaacgccaaggagagtaactgctctttgggtgacggtacctgagaagaaagccccggctaactacgtgccagcagccgcggtaatacgtagggggcgagcgttgtccggaattattgggcgtaaagcgcgcgcaggcggctttgtaagtcttgtgtctaaacccggggctcaaccccggggagcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatcccgctgacgggtctagagatagacctttccttcgggacagcggagacaggtggtgcatggttgtcgtcagctcgtgtcgtgagatgttgggttaagtcccgcaacgagcgcaacccttgattttagttgccagcacgtaaaggtgggcactctagaatgactgccggtgacaaaccggaggaaggcggggatgacgtcaaatcatcatgccccttatgacctgggctacacacgtactacaatggccggtacaacgggaagcgaaggagcgattcggagcgaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacccgcgagggagccagccgccgaaggtggggtagatgattggggtgaagtcgtaacaaggtagccgtatcggaaggtgcggctggatcacctcctttctaagga

SEQ ID NO: 6314 - DNA, 1414 bp, Paenibacillus sp. A3
  ref <308>: DATABASE ACCESSION NUMBER: NCBI ACCESSION: NZ_JTHN01000071.1
  ref <309>: DATABASE ENTRY DATE: 2019-04-01
  ref <313>: RELEVANT RESIDUES IN SEQ ID NO: (1)..(1414)
gggataactaccggaaacggtagctaagaccggataagtggtcttctcgcatgaggagatcaagaaacacggggcaacctgtggcttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtcgcggagagtaactgctctgcgaatgacggtacctgagaagaaagccccggctaactacgtgccagcagccgcggtaatacgtagggggcaagcgttgtccggaattattgggcgtaaagcgcgcgcaggcggccgcttaagtctggtgtttaagcccggggctcaacctcggttcgcactggaaactgggcggcttgagtgcaggagaggaaagcggaattccacgtgtagcggtgaaatgcgtagagatgtggaggaacaccagtggcgaaggcggctttctggcctgtaactgacgctgaggcgcgaaagcgtggggagcaaacaggattagataccctggtagtccacgccgtaaacgatgagtgctaggtgttaggggtttcgatacccttggtgccgaagtaaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctctgaatatcctagagatagggtaggccttcgggacagaggagacaggtggtgcatggttgtcgtcagctcgtgtcgtgagatgttgggttaagtcccgcaacgagcgcaacccttgaacttagttgccagcattgagttgggcactctaagttgactgccggtgacaaaccggaggaaggtggggatgacgtcaaatcatcatgccccttatgacctgggctacacacgtactacaatggccggtacaacgggaagcgaagtcgcgagatggagccaatcctaagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggag

SEQ ID NO: 6315 - DNA, 1562 bp, Paenibacillus sp. A59
  ref <308>: DATABASE ACCESSION NUMBER: NCBI ACCESSION: NZ_LITU01000007.1
  ref <309>: DATABASE ENTRY DATE: 2019-04-01
  ref <313>: RELEVANT RESIDUES IN SEQ ID NO: (1)..(1562)
tttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagtttgggacaactaccggaaacggtagctaataccgaatagttgttttcttcacctgaagagaactggaaagacggagcaatctgtcacttggggatgggcctgcggcgcaatagctagttggtggggtaacggctcaccaaggcgacgatgcgtagccgacctgagaggttgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcggtacagagatgtatctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6316 - DNA, 1564 bp, Paenibacillus sp. AD87
  ref <308>: DATABASE ACCESSION NUMBER: NCBI ACCESSION: NZ_LXQN01000021.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcatgcctaatacatgcaagtcgagcggacttgaagagaagcttgcttctcggatggttagcggcggacgggtgagtaacacgtaggcaacctgccctcaagtttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtggcggctggatcacctcctttctatggaga

SEQ ID NO: 6317 - DNA, 1558 bp, Paenibacillus sp. D9
  ref <308>: DATABASE ACCESSION NUMBER: NCBI ACCESSION: NZ_JZEJ01000001.1
  ref <309>: DATABASE ENTRY DATE: 2019-04-01
  ref <313>: RELEVANT RESIDUES IN SEQ ID NO: (1)..(1558)
cttttatggagagtttgatcctggctcaggacgaacgctggcggcgtgcctaatacatgcaagtcgagcggatcttgtccttcgggacaaggttagcggcggacgggtgagtaacacgtaggcaacctgccctcaagactgggataacctccggaaacggatgctaataccggatatgcggtctctcctcctggagggatcgggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaacgggtggaagagtaactgcttccgccatgacggtacctgagaagaaagccccggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccccctgaatcacctagagataggtgcggccttcgggacaggggagacaggtggtgcatggttgtcgtcagctcgtgtcgtgagatgttgggttaagtcccgcaacgagcgcaacccttgaattcagttgccagcacgtaagggtgggcactctgaattgactgccggtgacaaaccggaggaaggcggggatgacgtcaaatcatcatgccccttatgacctgggctacacacgtactacaatggccggtacaacgggccgcgaagccgcgaggcggagccaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6318 - DNA, 1567 bp, Paenibacillus sp. DMB20
  ref <308>: DATABASE ACCESSION NUMBER: NCBI ACCESSION: NZ_LAZU01000005.1
  ref <309>: DATABASE ENTRY DATE: 2019-04-01
  ref <313>: RELEVANT RESIDUES IN SEQ ID NO: (1)..(1567)
atccttattggagagtttgatcctggctcaggacgaacgctggcggcgtgcctaatacatgcaagtcgagcggagctgatgaggtgcttgcacctcagatgcttagcggcggacgggtgagtaacacgtaggcaacctgccctcaagactgggataactaccggaaacggtagctaataccggataatttatttcgccgcatggcggaataatgaaagacggagcaatctgtcacttgaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtctcatagagtaactgctatgagagtgacggtacctgagaagaaagccccggctaactacgtgccagcagccgcggtaatacgtagggggcaagcgttgtccggaattattgggcgtaaagcgcgcgcaggcggttctttaagtctggtgtttaaacctggggctcaacttcaggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtacagagatgtacctttccttcgggacaggggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggctggtacaacgggaagcgaaggagcgatctggagccaatcctaaaaaggcagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccctaacgggagccagccgccgaaggtggggtagatgattggggtgaagtcgtaacaaggtagccgtatcggaaggtgcggctggatcacctcctttctatggaga

SEQ ID NO: 6319 - DNA, 1073 bp, Paenibacillus sp. E194
  ref <308>: DATABASE ACCESSION NUMBER: NCBI ACCESSION: NZ_JMDX01000504.1
  ref <309>: DATABASE ENTRY DATE: 2019-04-01
  ref <313>: RELEVANT RESIDUES IN SEQ ID NO: (1)..(1073)
agggtgacggtacctgagaagaaagccccggctaactacgtgccagcagccgcggtaatacgtagggggcgagcgttgtccggaattattgggcgtaaagcgcgcgcaggcggcaatgtaagttgggtgtttaaacctagggctcaaccttgggtcgcatccaaaactgcatagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccgtcctagagatagggctttccttcgggacattcaagacaggtggtgcatggttgtcgtcagctcgtgtcgtgagatgttgggttaagtcccgcaacgagcgcaacccttaactttagttgccagcattcagttgggcactctagagtgactgccggtgacaaaccggaggaaggtggggatgacgtcaaatcatcatgccccttatgacctgggctacacacgtactacaatggtcggtacaacgggaagcgaagccgcgaggtggagccaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctaagga

SEQ ID NO: 6320 - DNA, 1559 bp, Paenibacillus sp. FF9
  ref <308>: DATABASE ACCESSION NUMBER: NCBI ACCESSION: NZ_CDSE01000019.1
  ref <309>: DATABASE ENTRY DATE: 2019-04-01
  ref <313>: RELEVANT RESIDUES IN SEQ ID NO: (1)..(1559)
tggagagtttgatcctggctcaggacgaacgctggcggcgtgcctaatacatgcaagtcgagcgaacttgatggagtgcttgcactcctgaaggttagcggcggacgggtgagtaacacgtaggcaacctgccctcaagactgggataactaccggaaacggtagctaataccggataatttatttcgctgcatggtggaataatgaaaggcggagcaatctgtcacttgaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgagagagtaactgctcttgaggtgacggtacctgagaagaaagccccggctaactacgtgccagcagccgcggtaatacgtagggggcaagcgttgtccggaattattgggcgtaaagcgcgcgcaggcggttctttaagtctggtgtttaaaccatgggctcaacttgtggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6321 - DNA, 1142 bp, Paenibacillus sp. FJAT-26967
  ref <308>: DATABASE ACCESSION NUMBER: NCBI ACCESSION: NZ_LMXH01000001.1
  ref <309>: DATABASE ENTRY DATE: 2019-04-01
  ref <313>: RELEVANT RESIDUES IN SEQ ID NO: (1)..(1142)
cggagagtttgatcctggctcaggacgaacgctggcggcgtgcctaatacatgcaagtcgagcggaattgatgaagtgcttgcacttcggagatttagcggcggacgggtgagtaacacgtaggtaacctgcctgtaagatcgggataactaccggaaacggtagctaagaccggataagtggcctcctcgcatgaagaggtcaagaaaaagggtttcggctcttgcttacagatggacctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttctcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactggaagactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatcccgatgtaacacctagagataggtgccctcttcggagcatcggagacaggtggtgcatggttgtcgtcagctcgtgtcgtgagatgttgggttaagtcccgcaacgagcgcaacccttgaacttagttgccagcaggt

SEQ ID NO: 6322 - DNA, 1554 bp, Paenibacillus sp. FJAT-29882; identical to SEQ ID NO: 1737
  ref <308>: DATABASE ACCESSION NUMBER: NCBI ACCESSION: NZ_LMVB01000007.1
  ref <309>: DATABASE ENTRY DATE: 2019-04-01
  ref <313>: RELEVANT RESIDUES IN SEQ ID NO: (1)..(1554)

SEQ ID NO: 6323 - DNA, 1561 bp, Paenibacillus sp. FSL A5-0031
  ref <308>: DATABASE ACCESSION NUMBER: NCBI ACCESSION: NZ_MRTD01000002.1
  ref <309>: DATABASE ENTRY DATE: 2019-04-01
  ref <313>: RELEVANT RESIDUES IN SEQ ID NO: (1)..(1561)
tttggagagtttgatcctggctcaggacgaacgctggcggcgtgcctaatacatgcaagtcgagcggagttgatgaggtgcttgcacctctgatacttagcggcggacgggtgagtaacacgtgggtaacctgcctataagactgggataacattcggaaacgaatgctaataccggatacgcgatatggtcgcatgactgaatcgggaaagatggagcaatctatcacttatagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaatgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaacttggggctcaaccccaagtcgcaagggaaactgcaaagcttgagtacagaagaggaaagtggaattccacgtgtagcggtgaaatgcgtagagatgtggaggaacgccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatcccaatgaaagcattagagatagtgcccctcttcggagcattggagacaggtggtgcatggttgtcgtcagctcgtgtcgtgagatgttgggttaagtcccgcaacgagcgcaacccttgatcttagttgccagcacattatggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagctagccgtcgaaggtggggtagatgattggggtgaagtcgtaacaaggtagccgtatcggaaggtgcggctggatcacctcctttctaagga

SEQ ID NO: 6324 - DNA, 1462 bp, Paenibacillus sp. FSL H7-0326
  ref <308>: DATABASE ACCESSION NUMBER: NCBI ACCESSION: NZ_MPVN01000021.1
  ref <309>: DATABASE ENTRY DATE: 2019-04-01
  ref <313>: RELEVANT RESIDUES IN SEQ ID NO: (1)..(1462)
ttagcggcggacgggtgagtaacacgtaggtaacctgcccataagactgggataactaccggaaacggtagctaataccggataggttcttctctcgcatgggaggggaaagaaagacggagcaatctgtcacttatggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcttagagtaactgctaagagagtgacggtacctgagaagaaagccccggctaactacgtgccagcagccgcggtaatacgtagggggcaagcgttgtccggaattattgggcgtaaagcgcgcgcaggcggtcatttaagttgggtgtttaaccccagggctcaaccctgggtcgcacccaaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtatagagatatacctttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccagtacaacgggaagcgaagccgcgaggtggagccaatcctaaaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctatggag

SEQ ID NO: 6325 - DNA, 1548 bp, Paenibacillus sp. FSL H7-0331
  ref <308>: DATABASE ACCESSION NUMBER: NCBI ACCESSION: NZ_MRTH01000005.1
  ref <309>: DATABASE ENTRY DATE: 2019-04-01
  ref <313>: RELEVANT RESIDUES IN SEQ ID NO: (1)..(1548)
tggagagtttgatcctggctcaggacgaacgctggcggcgtgcctaatacatgcaagtcgagcggattgttccttcgggaacagttagcggcggacgggtgagtaacacgtaggcaacctgcctacaggatcgggataactaccggaaacggtagctaagaccggatacaagactttgacgcatgtcagagtttggaaacacggagtaatctgtgacctgtagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaaaggccaggagagtaactgctcctggattgacggtacctgagaagaaagccccggctaactacgtgccagcagccgcggtaatacgtagggggcaagcgttgtccggaattattgggcgtaaagcgcgcgcaggcggtcatttaagtttggtgtttaattccggggctcaaccccgggtcgcatcgaaaactgggtgactggagtgcgggagaggaaagtggaattccacgtgtagcggtgaaatgcgtagagatgtggaggaacaccagtggcgaaggcgactttctggaccgtaactgacgctgaggcgcgaaagcgtggggagcaaacaggattagataccctggtagtccacgccgtaaacgatgagtgctaggtgtcgggggtttcaatacccgcggtgccgaagttaacacagtaagcactccgcctggggagtacgctcgcaagagtgaaactcaaaggaattgacggggacccgcacaagcagtggagtatgtggtttaattcgaagcaacgcgaagaaccttaccaggtcttgacatcccattgaaaagtgcagagatgtgctccctcttcggagcaatggagacaggtggtgcatggttgtcgtcagctcgtgtcgtgagatgttgggttaagtcccgcaacgagcgcaacccttggatttagttgccagcattgagttgggcactctagatcgactgccggtgacaaaccggaggaaggcggggatgacgtcaaatcatcatgccccttatgacctgggctacacacgtactacaatggccggtacaacgggaagcgaaaccgcgaggtggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6326 - DNA, 1563 bp, Paenibacillus sp. FSL H7-0357
  ref <308>: DATABASE ACCESSION NUMBER: NCBI ACCESSION: NZ_CP009241.1
  ref <309>: DATABASE ENTRY DATE: 2019-04-01
  ref <313>: RELEVANT RESIDUES IN SEQ ID NO: (1)..(1563)
tttggagagtttgatcctggctcaggacgaacgctggcggcgtgcctaatacatgcaagtcgagcggagttatgatggagcttgctccggattaacttagcggcggacgggtgagtaacacgtaggcaacctacctctttgactgggataactaccggaaacggtagctaataccggataattcctttgttcacatggacgaaggatgaaaggcggagcaatctgctacaaggagatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccattagagatagtggcggccttcgggacagaggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaaaccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6327 - DNA, 1564 bp, Paenibacillus sp. FSL H7-0737
  ref <308>: DATABASE ACCESSION NUMBER: NCBI ACCESSION: NZ_CP009279.1
  ref <309>: DATABASE ENTRY DATE: 2019-04-01
  ref <313>: RELEVANT RESIDUES IN SEQ ID NO: (1)..(1564)
ttggagagtttgatcctggctcaggacgaacgctggcggcgtgcctaatacatgcaagtcgagcggagttactttgaaagcttgctttcaaagtaacttagcggcggacgggtgagtaacacgtaggcaacctgccccttagactgggataactaccggaaacggtagctaataccggataatttcttttttctcctgaagaaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaagtaatgttgggcactctagagtgactgccggtgacaaaccggaggaaggtggggatgacgtcaaatcatcatgccccttatgacctgggctacacacgtactacaatggccggtacaacgggaagcgaagccgcgaggtgaagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6328 - DNA, 778 bp, Paenibacillus sp. FSL H7-689
  ref <308>: DATABASE ACCESSION NUMBER: NCBI ACCESSION: NZ_ASPU01000018.1
  ref <309>: DATABASE ENTRY DATE: 2019-04-01
  ref <313>: RELEVANT RESIDUES IN SEQ ID NO: (1)..(778)
cttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 6329 - DNA, 1565 bp, Paenibacillus sp. FSL H8-0259
  ref <308>: DATABASE ACCESSION NUMBER: NCBI ACCESSION: NZ_MRTL01000014.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagtttgaatggaagcttgcttccattcatgcttagcggcggacgggtgagtaacacgtaggcaacctgccctcaagactgggataactaccggaaacggtagctaataccggataatttctttcctctcctgaagagagaatgaaaggcggagcaatctgccacttggggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgaaagcattagagatagtgcccctcttcggagcatcggagacaggtggtgcatggttgtcgtcagctcgtgtcgtgagatgttgggttaagtcccgcaacgagcgcaacccttgactttagttgccagcaggtagtgctgggcactctagagtgactgccggtgacaaaccggaggaaggtggggatgacgtcaaatcatcatgccccttatgacctgggctacacacgtactacaatggccggtacaacgggaagcgaaaccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6330 - DNA, 1538 bp, Paenibacillus sp. FSL H8-0548
  ref <308>: DATABASE ACCESSION NUMBER: NCBI ACCESSION: NZ_MRTK01000011.1
  ref <309>: DATABASE ENTRY DATE: 2019-04-01
  ref <313>: RELEVANT RESIDUES IN SEQ ID NO: (1)..(1538)
tggagagtttgatcctggctcaggacgaacgctggcgtcgagcggagttgatgagatgcttgcatctctgatacttagcggcggacgggtgagtaacacgtgggtaacctgcctttaagactgggataacattcggaaacgaatgctaataccggatacgcggcttgatcgcatgatcgagccgggaaagatggagcaatctatcacttaaagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgggatagtaactgctcccaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaacttggggctcaaccccaagtcgcaatggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgctctagagatagggctttccttcgggacagaggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagctagccgtcgaaggtggggtagatgattggggtgaagtcgtaacaaggtagccgtatcggaaggtgcggctggatcacctcctttctaagga

SEQ ID NO: 6331 - DNA, 1468 bp, Paenibacillus sp. FSL H8-237
  ref <308>: DATABASE ACCESSION NUMBER: NCBI ACCESSION: NZ_ASPV01000020.1
  ref <309>: DATABASE ENTRY DATE: 2019-04-01
  ref <313>: RELEVANT RESIDUES IN SEQ ID NO: (1)..(1468)
acttagcggcggacgggtgagtaacacgtaggcaacctgcccttcagactgggataactaccggaaacggtagctaataccggataatttcttttttctcctgagagaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttaactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggggggtagatgattggggtgaagtcgtaacaaggtagccgtatcggaaggtgcggctggatcacctcctttctatggaga

SEQ ID NO: 6332 - DNA, 1462 bp, Paenibacillus sp. FSL H8-457
  ref <308>: DATABASE ACCESSION NUMBER: NCBI ACCESSION: NZ_ASPW01000020.1
  ref <309>: DATABASE ENTRY DATE: 2019-04-01
  ref <313>: RELEVANT RESIDUES IN SEQ ID NO: (1)..(1462)
tgatggagtgcttgcactcctgatggttagcggcggacgggtgagtaacacgtaggcaacctgccctcaagactgggataactaccggaaacggtagctaataccggataatttattttgcagcattgtgaaataatgaaaggcggagcaatctgtcacttgaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttaggggagccagccgccgaaggtggggtagatgattggggtgaagtcgtaacaaggtagccgtatcggaagg

SEQ ID NO: 6333 - DNA, 1565 bp, Paenibacillus sp. FSL P4-0081
  ref <308>: DATABASE ACCESSION NUMBER: NCBI ACCESSION: NZ_CP009280.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagtttgaatggaagcttgcttccattcttacttagcggcggacgggtgagtaacacgtaggcaacctgccctcaagactgggataactaccggaaacggtagctaataccggataatttctttcctctcctgaagagagaatgaaaggcggagtaatctgccgcttggggatgggcctgcggcgcattagctagttggtggggtaatggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgaaagcattagagatagtgcccctcttcggagcatcggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6334 - DNA, 1564 bp, Paenibacillus sp. FSL R5-0345
  ref <308>: DATABASE ACCESSION NUMBER: NCBI ACCESSION: NZ_CP009281.1
  ref <309>: DATABASE ENTRY DATE: 2019-04-01
  ref <313>: RELEVANT RESIDUES IN SEQ ID NO: (1)..(1564)
ttggagagtttgatcctggctcaggacgaacgctggcggcgtgcctaatacatgcaagtcgagcggagttattttgaaagcttgctttcaaaataacttagcggcggacgggtgagtaacacgtaggcaacctgccccttagactgggataactaccggaaacggtagctaataccggataatttcttttttctcctgaaggaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttaactttagttgccagcaagtaatgttgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6335 - DNA, 1555 bp, Paenibacillus sp. FSL R5-0490
  ref <308>: DATABASE ACCESSION NUMBER: NCBI ACCESSION: NZ_MRTQ01000010.1
  ref <309>: DATABASE ENTRY DATE: 2019-04-01
  ref <313>: RELEVANT RESIDUES IN SEQ ID NO: (1)..(1555)
ttatatggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataactcttttcctcacatgaggaaaagctgaaagatggtttcggctatcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 6336 - DNA, 858 bp, Paenibacillus sp. FSL R5-0765
  ref <308>: DATABASE ACCESSION NUMBER: NCBI ACCESSION: NZ_MRTS01000060.1
  ref <309>: DATABASE ENTRY DATE: 2019-04-01
  ref <313>: RELEVANT RESIDUES IN SEQ ID NO: (1)..(858)
aataccgaatagttgttttcttcgcctgaagaaaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcgatacagagatg

SEQ ID NO: 6337 - DNA, 1565 bp, Paenibacillus sp. FSL R5-0912
  ref <308>: DATABASE ACCESSION NUMBER: NCBI ACCESSION: NZ_CP009282.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagttcatttgaaagcttgctttcaaatgaacttagcggcggacgggtgagtaacacgtaggcaacctgccctcaagactgggataactaccggaaacggtagctaataccggataatttctttcctctcctgaagagagaatgaaaggcggagcaatctgccacttggggatgggcctgcggcgcattagctagttggtggggtaatggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgaaagcattagagatagtgcccctcttcggagcatcggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaaaccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6338 - DNA, 910 bp, Paenibacillus sp. FSL R5-192
  ref <308>: DATABASE ACCESSION NUMBER: NCBI ACCESSION: NZ_ASPR01000029.1
  ref <309>: DATABASE ENTRY DATE: 2019-04-01
  ref <313>: RELEVANT RESIDUES IN SEQ ID NO: (1)..(910)
ttagcggcggacgggtgagtaacacgtaggcaacctgccctcaagtttgggacaactaccggaaacggtagctaataccgaataattgttttcttcgcctgaaggaaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 6339 - DNA, 1356 bp, Paenibacillus sp. FSL R5-808
  ref <308>: DATABASE ACCESSION NUMBER: NCBI ACCESSION: NZ_ASPT01000010.1
  ref <309>: DATABASE ENTRY DATE: 2019-04-01
  ref <313>: RELEVANT RESIDUES IN SEQ ID NO: (1)..(1356)
gataatgaaagacggagcaatctgtcacttggggatgggcctgcggcgcattagctagttggtggggtaatggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtctcatagagtaactgctatgagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacctggggctcaacttcaggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatctgctagagatagcagcggccttcgggacagaggagacaggtggtgcatggttgtcgtcagctcgtgtcgtgagatgttgggttaagtcccgcaacgagcgcaacccttgattttagttgccagcaggtaaggctgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttcta

SEQ ID NO: 6340 - DNA, 1555 bp, Paenibacillus sp. FSL R7-0273
  ref <308>: DATABASE ACCESSION NUMBER: NCBI ACCESSION: NZ_MRTY01000074.1
  ref <309>: DATABASE ENTRY DATE: 2019-04-01
  ref <313>: RELEVANT RESIDUES IN SEQ ID NO: (1)..(1555)
tttggagagtttgatcctggctcaggacgaacgctggcggcgtgcctaatacatgcaagtcgagcggagcttatccttcggggtaagcttagcggcggacgggtgagtaacacgtaggcaacctgccccttagcctgggataactaccggaaacggtagctaataccggataatttcttttttctcatgaagggagaatgaaaggcggagcaatctgtcattaagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgaaagcattagagatagtgcccctcttcggagcatcggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccagtacaacgggaagcgaagccgcgaggtggagccaatcccagcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6341 - DNA, 1555 bp, Paenibacillus sp. FSL R7-0331
  ref <308>: DATABASE ACCESSION NUMBER: NCBI ACCESSION: NZ_CP009284.1
  ref <309>: DATABASE ENTRY DATE: 2019-04-01
  ref <313>: RELEVANT RESIDUES IN SEQ ID NO: (1)..(1555)
tttggagagtttgatcctggctcaggacgaacgctggcggcgtgcctaatacatgcaagtcgagcggagtttatccttcggggtaagcttagcggcggacgggtgagtaacacgtaggcaacctgccccttaacctgggataactaccggaaacggtagctaataccggataatttcttttttctcctgaagagagaatgaaaggcggagcaatctgtcattaagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccggtgtaagcattagagatagtgcccctcttcggagcatcggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccagtacaacgggaagcgaagccgcgaggtggagccaatcccagcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6342 - DNA, 1568 bp, Paenibacillus sp. FSL R7-0333
  ref <308>: DATABASE ACCESSION NUMBER: NCBI ACCESSION: NZ_MRTW01000044.1
  ref <309>: DATABASE ENTRY DATE: 2019-04-01
  ref <313>: RELEVANT RESIDUES IN SEQ ID NO: (1)..(1568)
tttggagagtttgatcctggctcaggacgaacgctggcggcatgcctaatacatgcaagtcgagcggagtctgaaaggaagcttgcttcctttcagacttagcggcggacgggtgagtaacacgtaggcaacctgccctcaagcctgggataactaccggaaacggtagctaataccggataatttcttttttctcctgagagaagaatgaaaggcggagcaatctgctgcttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgcaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggttatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6343 - DNA, 1568 bp, Paenibacillus sp. FSL R7-0337
  ref <308>: DATABASE ACCESSION NUMBER: NCBI ACCESSION: NZ_MRTX01000020.1
  ref <309>: DATABASE ENTRY DATE: 2019-04-01
  ref <313>: RELEVANT RESIDUES IN SEQ ID NO: (1)..(1568)
tttggagagtttgatcctggctcaggacgaacgctggcggcgtgcctaatacatgcaagtcgagcggagtctgaaaggaagcttgcttcctttcagacttagcggcggacgggtgagtaacacgtaggcaacctgccctcaagcctgggataactaccggaaacggtagctaataccggataatttcttttttctcctgaggagagaatgaaaggcggagcaatctgctgcttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgcaagcctgacggagcaacgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggttatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6344 - DNA, 1497 bp, Paenibacillus sp. FSL R7-269
  ref <308>: DATABASE ACCESSION NUMBER: NCBI ACCESSION: NZ_ASPS01000117.1
  ref <309>: DATABASE ENTRY DATE: 2019-04-01
  ref <313>: RELEVANT RESIDUES IN SEQ ID NO: (1)..(1497)
tgaaaggaagcttgcttcctttcagacttagcggcggacgggtgagtaacacgtaggcaacctgccctcaagcctgggataactaccggaaacggtagctaataccggataatttcttttttctcctgaggagagaatgaaaggcggagcaatctgctgcttggggatgggcctgcggcgcattagctagttggtggggtaatggcccaccaaggcgacgatgcgtagccgacctgagagggtgaacggccacactgggactgagacacggcccagactcctacgggaggcagcagtagggaatcttccgcaatgggcgcaagcctgacggagcaacgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggttatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6345 - DNA, 1364 bp, Paenibacillus sp. FSL R7-277
  ref <308>: DATABASE ACCESSION NUMBER: NCBI ACCESSION: NZ_ASPX01000049.1
  ref <309>: DATABASE ENTRY DATE: 2019-04-01
  ref <313>: RELEVANT RESIDUES IN SEQ ID NO: (1)..(1364)
agaatgaaaggcggagcaatctgctgcttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgcaagcctgacggagcaatgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggttatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6346 - DNA, 1563 bp, Paenibacillus sp. GM2
  ref <308>: DATABASE ACCESSION NUMBER: NCBI ACCESSION: NZ_CTEK01000008.1
  ref <309>: DATABASE ENTRY DATE: 2019-04-01
  ref <313>: RELEVANT RESIDUES IN SEQ ID NO: (1)..(1563)
tttattggagagtttgatcctggctcaggacgaacgctggcggcgtgcctaatacatgcaagtcgagcggacttgatggagagcttgctctccagagagttagcggcggacgggtgagtaacacgtaggtaacctgcctgtaagactgggataactagcggaaacgttagctaataccggataatttattttctcgcatggggaagtaatgaaagacggagcaatctgtcacttgcagatggacctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgttcggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctgatgtttaatcctaaggctcaaccttaggtcgcattggaaactgggtagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtgcctttccttcgggacagaggagacaggtggtgcatggttgtcgtcagctcgtgtcgtgagatgttgggttaagtcccgcaacgagcgcaacccttgattttagttgccagcacataaaggtgggcactctagaatgactgccggtgacaaaccggaggaaggcggggatgacgtcaaatcatcatgccccttatgacctgggctacacacgtactacaatggctggtacaacgggaagcgaagtcgcgagatggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggaga

SEQ ID NO: 6347 - DNA, 1328 bp, Paenibacillus sp. HGH0039
  ref <308>: DATABASE ACCESSION NUMBER: NCBI ACCESSION: NZ_KE150412.1
  ref <309>: DATABASE ENTRY DATE: 2019-04-01
  ref <313>: RELEVANT RESIDUES IN SEQ ID NO: (1)..(1328)
ggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccctctgaccggcttagagataagcctttccttcgggacagaggtgacaggtggtgcatggttgtcgtcagctcgtgtcgtgagatgttgggttaagtcccgcaacgagcgcaacccttgaacttagttgccagcaggttaggctgggcactctaagttgactgccggtgacaaaccggaggaaggcggggatgacgtcaaatcatcatgccccttatgacctgggctacacacgtactacaatggccggtacaacgggaagcgaaggagcgatctggagccaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggaga

SEQ ID NO: 6348 - DNA, 1558 bp, Paenibacillus sp. HW567
  misc_feature (211)..(212): n is a, c, g, or t
  misc_feature (474)..(474): n is a, c, g, or t
  misc_feature (591)..(591): n is a, c, g, or t
  ref <308>: DATABASE ACCESSION NUMBER: NCBI ACCESSION: NZ_KB910518.1
  ref <309>: DATABASE ENTRY DATE: 2019-04-01
  ref <313>: RELEVANT RESIDUES IN SEQ ID NO: (1)..(1558)
tttggagagtttgatcctggctcaggacgaacgctggcggcgtgcctaatacatgcaagtcgagcggagcttatccttcggggtaagcttagcggcggacgggtgagtaacacgtaggcaacctaccctgtagactgggataactaccggaaacggtagctaataccggataattcctttcttctcctgaaggaaggatgaaaggcggagnnatctgctactagaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctancggagtgacggtacctgagaagaaagccccggctaactacgtgccagcagccgcggtaatacgtagggggcaagcgttgtccggaattattgggcgtaaagcgcgcgcaggcggctntttaagtctggtgtttaaaccttgggctcaacctggggtcgcactggaaactggatggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagcaaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 6349 - DNA, 1562 bp, Paenibacillus sp. IHBB 10380
  ref <308>: DATABASE ACCESSION NUMBER: NCBI ACCESSION: NZ_CP010976.1
  ref <309>: DATABASE ENTRY DATE: 2019-04-01
  ref <313>: RELEVANT RESIDUES IN SEQ ID NO: (1)..(1562)
ttggagagtttgatcctggctcaggacgaacgctggcggcgtgcctaatacatgcaagtcgagcggagttgatggagtgcttgcactcctgatactcagcggcggacgggtgagtaacacgtaggtaacctgcctgtgagactgggataactaccggaaacggtagctaataccggataatacattttctctcctgaggagatgttgaaaggcggagcaatctgtcacttacagatggacctgcggcgcattagcttgttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaagattcaggagagtaactgctcctggagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccgggtcgcactggaaactgggtgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttatgcttagttgccagcacattatggtgggcactctaaacagactgccggtgacaaaccggaggaaggtggggatgacgtcaaatcatcatgccccttatgacctgggctacacacgtactacaatggccggtacaacgggctgcgaaatcgcgagatggagccaatcccaccaaagccggtctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6350 - DNA, 1563 bp, Paenibacillus sp. IHB B 3415
  ref <308>: DATABASE ACCESSION NUMBER: NCBI ACCESSION: NZ_JUEI01000110.1
  ref <309>: DATABASE ENTRY DATE: 2019-04-01
  ref <313>: RELEVANT RESIDUES IN SEQ ID NO: (1)..(1563)
tttggagagtttgatcctggctcaggacgaacgctggcggcatgcctaatacatgcaagtcgagcggagttatgaaggagcttgctctggaataacttagcggcggacgggtgagtaacacgtaggcaacctgccctcaagactgggataactaccggaaacggtagctaataccggataatttctttcctctcctgaagagagaatgaaaggcggagcaatctgccacttggggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgaaagcattagagatagtgcccctcttcggagcatcggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaaaccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6351 - DNA, 294 bp, Paenibacillus sp. J14
  misc_feature (96)..(96): n is a, c, g, or t
  ref <308>: DATABASE ACCESSION NUMBER: NCBI ACCESSION: NZ_JADQ01000029.1
  ref <309>: DATABASE ENTRY DATE: 2019-04-01
  ref <313>: RELEVANT RESIDUES IN SEQ ID NO: (1)..(294)
tttattggagagtttgatcctggctcaggacgaacgctggcggcgtgcctaatacatgcaagtcgagcggagtttatcgggagcttgctcctgatnaacttagcggcggacgggtgagtaacacgtaggcaacctgcccgtaagactgggataactaccggaaacggtagctaataccggatacgcaagtctctcgcatgaggggcttgggaaaggcggagcaatctgtcacttacggatgggcctgcggcgcattagctagttggtggggtaacggctcaccaaggcgacgat

SEQ ID NO: 6352 - DNA, 336 bp, Paenibacillus sp. J6
  ref <308>: DATABASE ACCESSION NUMBER: NCBI ACCESSION: NZ_FXAB01000063.1
  ref <309>: DATABASE ENTRY DATE: 2019-04-01
  ref <313>: RELEVANT RESIDUES IN SEQ ID NO: (1)..(336)
tttattggagagtttgatcctggctcaggacgaacgctggcggcgtgcctaatacatgcaagtcgagcggagttcatcgggagcttgctcctgatgaacttagcggcggacgggtgagtaacacgtaggcaacctgcccgtaagactgggataactaccggaaacggtagctaataccggatacgcaagtctctcgcatgaggggcttgggaaaggcggagcaatctgtcacttacggatgggcctgcggcgcattagctagttggtggggtaacggctcaccaaggcgacgatgcgtagccgacctgagagggtgaacggccacactgggactga

SEQ ID NO: 6353 - DNA, 1492 bp, Paenibacillus sp. LC231
  ref <308>: DATABASE ACCESSION NUMBER: NCBI ACCESSION: NZ_JFOM01000042.1
  ref <309>: DATABASE ENTRY DATE: 2019-04-01
  ref <313>: RELEVANT RESIDUES IN SEQ ID NO: (1)..(1492)
tgatggagtgcttgcactcctgatggttagcggcggacgggtgagtaacacgtaggcaacctgccctcaagactgggataactaccggaaacggtagctaataccggataatttatttcacagcattgtggaataatgaaagacggagcaatctgtcacttggggatgggcctgcggcgcattagctagttggtggggtaatggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6354 - DNA, 1431 bp, Paenibacillus sp. Leaf72
  ref <308>: DATABASE ACCESSION NUMBER: NCBI ACCESSION: NZ_LMLV01000012.1
  ref <309>: DATABASE ENTRY DATE: 2019-04-01
  ref <313>: RELEVANT RESIDUES IN SEQ ID NO: (1)..(1431)
tggagagtttgatcctggctcaggacgaacgctggcggcgtgcctaatacatgcaagtcgagcggagttgatggagtgcttgcactcctgatgttagcggcggacgggtgagtaacacgtaggtaacctgcccgtaagactgggataacattcggaaacgaatgctaataccggatacacaacttggtcgcatgatcggagttgggaaagacggagcaatctgtcacttacggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctaaggagagtaactgctctttaggtgacggtacctgagaagaaagccccggctaactacgtgccagcagccgcggtaatacgtagggggcaagcgttgtccggaattattgggcgtaaagcgcgcgcaggcggccttgtaagtctgttgtttcaggcacaagctcaacttgtgttcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgacaggtgaagctgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 6355 - DNA, 1562 bp, Paenibacillus sp. MAEPY1
  ref <308>: DATABASE ACCESSION NUMBER: NCBI ACCESSION: NZ_AWUJ01000055.1
  ref <309>: DATABASE ENTRY DATE: 2019-04-01
  ref <313>: RELEVANT RESIDUES IN SEQ ID NO: (1)..(1562)
tttattggagagtttgatcctggctcaggacgaacgctggcggcatgcctaatacatgcaagtcgagcggacttgaagagaagcttgcttctcggatggttagcggcggacgggtgagtaacacgtaggcaacctgccctcaagcttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6356 - DNA, 1562 bp, Paenibacillus sp. MAEPY2
  ref <308>: DATABASE ACCESSION NUMBER: NCBI ACCESSION: NZ_AWUK01000051.1
  ref <309>: DATABASE ENTRY DATE: 2019-04-01
  ref <313>: RELEVANT RESIDUES IN SEQ ID NO: (1)..(1562)
tttattggagagtttgatcctggctcaggacgaacgctggcggcatgcctaatacatgcaagtcgagcggacttgaagagaagcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6357 - DNA, 1353 bp, Paenibacillus sp. NAIST15-1
  ref <308>: DATABASE ACCESSION NUMBER: NCBI ACCESSION: NZ_BBYF01000035.1
  ref <309>: DATABASE ENTRY DATE: 2019-04-01
  ref <313>: RELEVANT RESIDUES IN SEQ ID NO: (1)..(1353)
atgagaaaggcggagcaatctgccacttatggatggacctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcctaggagagtaactgctcctagggtgacggtacctgagaagaaagccccggctaactacgtgccagcagccgcggtaatacgtagggggcgagcgttgtccggaattattgggcgtaaagcgcgcgcaggcggcaatgtaagttgggtgtttaaacctagggctcaaccttgggtcgcatccaaaactgcatagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccgtcctagagatagggctttccttcgggacattcaagacaggtggtgcatggttgtcgtcagctcgtgtcgtgagatgttgggttaagtcccgcaacgagcgcaacccttaactttagttgccagcattcagttgggcactctagagtgactgccggtgacaaaccggaggaaggtggggatgacgtcaaatcatcatgccccttatgacctgggctacacacgtactacaatggtcggtacaacgggaagcgaagccgcgaggtggagccaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctaagga

SEQ ID NO: 6358 - DNA, 1557 bp, Paenibacillus sp. P22
  ref <308>: DATABASE ACCESSION NUMBER: NCBI ACCESSION: NZ_CBRA020000002.1
  ref <309>: DATABASE ENTRY DATE: 2019-04-01
  ref <313>: RELEVANT RESIDUES IN SEQ ID NO: (1)..(1557)
cctttatggagagtttgatcctggctcaggacgaacgctggcggcgtgcctaatacatgcaagtcgagcggatcttgtccttcgggacaaggttagcggcggacgggtgagtaacacgtaggcaacctgccctcaagactgggataacctccggaaacggatgctaataccggatatgcggtctctcctcctggagggatcgggaaagacggagcaatctgtcgcttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaacgggtggaagagtaactgcttccgccatgacggtacctgagaagaaagccctggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccccctgaatcacctagagataggtgcggccttcgggacaggggagacaggtggtgcatggttgtcgtcagctcgtgtcgtgagatgttgggttaagtcccgcaacgagcgcaacccttgaattcagttgccagcacctcgggtgggcactctgaattgactgccggtgacaaaccggaggaaggcggggatgacgtcaaatcatcatgccccttatgacctgggctacacacgtactacaatggccggtacaacgggccgcgaagccgcgaggcggagccaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6359 - DNA, 917 bp, Paenibacillus sp. P26E
  ref <308>: DATABASE ACCESSION NUMBER: NCBI ACCESSION: NZ_LVWI01000120.1
  ref <309>: DATABASE ENTRY DATE: 2019-04-01
  ref <313>: RELEVANT RESIDUES IN SEQ ID NO: (1)..(917)
ctgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtagtgctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 6360 - DNA, 1291 bp, Paenibacillus sp. P32E
  ref <308>: DATABASE ACCESSION NUMBER: NCBI ACCESSION: NZ_LVYY01000053.1
  ref <309>: DATABASE ENTRY DATE: 2019-04-01
  ref <313>: RELEVANT RESIDUES IN SEQ ID NO: (1)..(1291)
ggcctaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttgactttagttgccagcaggtagtgctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatgg

SEQ ID NO: 6361 - DNA, 1294 bp, Paenibacillus sp. P3E
  ref <308>: DATABASE ACCESSION NUMBER: NCBI ACCESSION: NZ_LVWH01000109.1
  ref <309>: DATABASE ENTRY DATE: 2019-04-01
  ref <313>: RELEVANT RESIDUES IN SEQ ID NO: (1)..(1294)
ggcctaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtagtgctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 6362 - DNA, 1408 bp, Paenibacillus sp. P46E
  ref <308>: DATABASE ACCESSION NUMBER: NCBI ACCESSION: NZ_LVYZ01000081.1
  ref <309>: DATABASE ENTRY DATE: 2019-04-01
  ref <313>: RELEVANT RESIDUES IN SEQ ID NO: (1)..(1408)
tttggagagtttgatcctggctcaggacgaacgctggcggcgtgcctaatacatgcaagtcgagcggagcttatccttcggggggaagcttagcggcggacgggtgagtaacacgtaggcaacctaccctctagactgggataactaccggaaacggtagctaataccggataattccttcaccctcctgggcgagggatgaaaggcggagcaatctgctactagaggatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatgggcgaaattgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaaggg

SEQ ID NO: 6363 - DNA, 1333 bp, Paenibacillus sp. RU4T; identical to SEQ ID NO: 799
  ref <308>: DATABASE ACCESSION NUMBER: NCBI ACCESSION: NZ_FTND01000016.1
  ref <309>: DATABASE ENTRY DATE: 2019-04-01
  ref <313>: RELEVANT RESIDUES IN SEQ ID NO: (1)..(1333)

SEQ ID NO: 6364 - DNA, 1333 bp, Paenibacillus sp. RU4X; identical to SEQ ID NO: 799
  ref <308>: DATABASE ACCESSION NUMBER: NCBI ACCESSION: NZ_FTLY01000016.1
  ref <309>: DATABASE ENTRY DATE: 2019-04-01
  ref <313>: RELEVANT RESIDUES IN SEQ ID NO: (1)..(1333)

SEQ ID NO: 6365 - DNA, 1465 bp, Paenibacillus sp. RU5A; identical to SEQ ID NO: 800
  ref <308>: DATABASE ACCESSION NUMBER: NCBI ACCESSION: NZ_FVZJ01000029.1
  ref <309>: DATABASE ENTRY DATE: 2019-04-01
  ref <313>: RELEVANT RESIDUES IN SEQ ID NO: (1)..(1465)

SEQ ID NO: 6366 - DNA, 1294 bp, Paenibacillus sp. Root444D2
  ref <308>: DATABASE ACCESSION NUMBER: NCBI ACCESSION: NZ_LMEO01000045.1
  ref <309>: DATABASE ENTRY DATE: 2019-04-01
  ref <313>: RELEVANT RESIDUES IN SEQ ID NO: (1)..(1294)
tatgaaacacggagyaatctgtggcttatagatgggcctgcggcgcattagctagttggtagggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaagrrgagtaactgcyytttgtgtgacggtataggagaagaaagccccggctaactacgtgccagcagccgcggtaatacgtagggggcaagcgttgtccggaattattgggcgtaaagcgcgcgcaggcggtymattaagttgggtgtttaagcccggggctcaaccccggttcgcatccaaaactggtkracttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgttggggattcgattcctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatccctwtgtaasccctagagatagggccctccttcgggacagaggagacaggtggtgcatggttgtcgtcagctcgtgtcgtgagatgttgggttaagtcccgcaacgagcgcaacccttgatcttagttgccagcacttygggtgggcactctaagatgactgccggtgacaaaccggaggaaggtggggatgacgtcaaatcatcatgccccttatgacctgggctacacacgtactacaatggtcggtacaacgggaagcgaagccgcgaggtggagccaatcctwawaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggcgg

SEQ ID NO: 6367 - DNA, 1563 bp, Paenibacillus sp. Root52
  ref <308>: DATABASE ACCESSION NUMBER: NCBI ACCESSION: NZ_LMFO01000023.1
  ref <309>: DATABASE ENTRY DATE: 2019-04-01
  ref <313>: RELEVANT RESIDUES IN SEQ ID NO: (1)..(1563)
tttattggagagtttgatcctggctcaggacgaacgctggcggcatgcctaatacatgcaagtcgagcggacttgawgagaagcttgcttctctgatggttagcggcggacgggtgagtaacacgtaggcaacctgccctcaagcttgggacaactaccggaaacggtagctaataccgaatacttgttttcttcgcctgaaggaaactggaaagayggagcaatctrtcacttgaggatgggcctgcggcgcattagctagttggtgaggtaacggctcaccaaggcgacgatgcgtagccgacctgagagggtgatcggccacactgggactgagacacggcycagactcctacgggaggcagcagtagggaatcttccgcaatrggcgaaagcctgacggagcaatgccgcgtgagtgatgaaggttttcggatcgtaaagctctgttgccagggaagaacgcttaggagagtaactgctcctgaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatcyswmtgaccggtrcagagatgtacctttycttcggracakwsragacaggtggtgcatggttgtcgtcagctcgtgtcgtgagatgttgggttaagtcccgcaacgagcgcaacccttatatttagttgccagcacttygggtgggcactctagatagactgccggtgacaaaccggaggaaggtggggatgacgtcaaatcatcatgccccttatgacctgggctacacacgtactacaatggccggtacaacgggctgcgaaaycgcgaggtggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6368 - DNA, 1619 bp, Paenibacillus sp. Soil522
  misc_feature (264)..(264): n is a, c, g, or t
  ref <308>: DATABASE ACCESSION NUMBER: NCBI ACCESSION: NZ_LMRV01000099.1
  ref <309>: DATABASE ENTRY DATE: 2019-04-01
  ref <313>: RELEVANT RESIDUES IN SEQ ID NO: (1)..(1619)
ctggcggcgtgcctaatacatgcaagtcgagcggatcttgtccttcgggacaagattagcggcggacgggtgagtaacacgtgggtaacctgcctgtaagacygggataacattcggaaacgratgctaataccggatacgcaatctggtcgcatgaccggattgggaaagatggagcaatctatcacttacagatggacccgcggcgcattagctagttggtgaggtaacggctcaccaaggcgacgatgcgtagccgacctngggaaagatggagcaatctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaatgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaacttggggctcaaccccaagtcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgctctagagatagggytttccttcgggacagaggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggggctagccgtcgaaggtggggtagatgattggggtgaagtcgtaacaaggtagccgtatcggaaggtgcggctggatcacctcctttctaagga

SEQ ID NO: 6369 - DNA, 1550 bp, Paenibacillus sp. Soil724D2
  ref <308>: DATABASE ACCESSION NUMBER: NCBI ACCESSION: NZ_LMRY01000023.1
  ref <309>: DATABASE ENTRY DATE: 2019-04-01
  ref <313>: RELEVANT RESIDUES IN SEQ ID NO: (1)..(1550)
ttatggagagtttgatcctggctcaggacgaacgctggcggcgtgcctaatacatgcaagtcgagcggatttatccttcgggataarttagcggcggacgggtgagtaacacgtaggtaacctgcctataagatcrggataactatcggaaacgatagctaagaccggataaytggttttctcgcatgagagaaytatgaarcacggagcaatctgtggcttatagatgggcctgcggcgcattagctagttggtagggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaagrrgagtaactgcyytttgtgtgacggtataggagaagaaagccccggctaactacgtgccagcagccgcggtaatacgtagggggcaagcgttgtccggaattattgggcgtaaagcgcgcgcaggcggtymattaagttgggtgtttaagcccggggctcaaccccggttcgcatccaaaactggtkracttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgttggggattcgattcctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatccctttgtaagccytagagatagggccctccttcgggacagaggagacaggtggtgcatggttgtcgtcagctcgtgtcgtgagatgttgggttaagtcccgcaacgagcgcaacccttgatcttagttgccagcacttyggrtgggcactctaagatgactgccggtgacaaaccggaggaaggtggggatgacgtcaaatcatcatgccccttatgacctgggctacacacgtactacaatggtcggtacaacgggaagcgaagccgcgaggtggagccaatcctwawaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgyaagggagccagccgccgaaggtggggtagatgattggggtgaagtcgtaacaaggtagccgtatcggaaggtgcggctggatcacctcctttctatggaga

SEQ ID NO: 6370 - DNA, 1519 bp, Paenibacillus sp. Soil750
  ref <308>: DATABASE ACCESSION NUMBER: NCBI ACCESSION: NZ_LMSD01000040.1
  ref <309>: DATABASE ENTRY DATE: 2019-04-01
  ref <313>: RELEVANT RESIDUES IN SEQ ID NO: (1)..(1519)
ttatggagagtttgatcctggctcaggacgaacgctggcggcgtgcctaatacatgcaagtcgagcgggtttatccttcgggataagctagcggcggacgggtgagtaacacgtaggtaacctgcctttaagactgggataactatcggaaacgatagctaagaccggataactggttttctcgcatgagagaatcataaaacacggagyaatctgtggcttraagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctgtgtgacggtataggagaagaaagccccggctaactacgtgccagcagccgcggtaatacgtagggggcaagcgttgtccggaattattgggcgtaaagcgcgcgcaggcggtcatttaagtctggtgtttaakccyggggctcaaccccrgttcgcatcggaaactggatgacttgagtgtargagaggaaagtggaattccacgtgtagcggtgaaatgcgtagagatgtggaggaacaccagtggcgaaggcgactttctggcttataactgacgctgaggcgcgaaagcgtggggagcaaacaggattagataccctggtagtccacgccgtaaacgatgcatactaggtgtcggggattcgatttctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatcccgatgtaacrcctagagataggygccctcttcggagcattggagacaggtggtgcatggttgtcgtcagctcgtgtcgtgagatgttgggttaagtcccgcaacgagcgcaacccttgatcttagttgccagcacttygggtgggcactctaggatgactgccggtgacaaaccggaggaaggtggggatgacgtcaaatcatcatgccccttatgacctgggctacacacgtactacaatggtcggtacaacgggaagcgaagccgcgaggtggagccaatccttataagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgyaagggagccagccgccgaaggtggggtagatgattggggtgaagtcgtaacaaggtagccgtatcggaaggtgcggctggatcacctcctttctatggaga

SEQ ID NO: 6371 - DNA, 1641 bp, Paenibacillus sp. Soil766
  ref <308>: DATABASE ACCESSION NUMBER: NCBI ACCESSION: NZ_LMSJ01000018.1
  ref <309>: DATABASE ENTRY DATE: 2019-04-01
  ref <313>: RELEVANT RESIDUES IN SEQ ID NO: (1)..(1641)
ttatggagagtttgatcctggctcaggacgaacgctggcggcgtgcctaatacatgcaagtcgagcgggtttatccttcgggayaagctagcggcggacgggtgagtaacacgtaggtaacctgcctttaagactgggataactatcggaaacgatagctaagaccggataactcaagctagcggcggacgggtgagtaacacgtaggtaacctgcctttaagactgggataactatcggaaacgatagctaagaccggataactggttttctcgcatgagagaatcataaaacacggagyaatctgtggcttrragatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaagaggagtaactgccttktgtgtgacggtataggagaagaaagccccggctaactacgtgccagcagccgcggtaatacgtagggggcaagcgttgtccggaattattgggcgtaaagcgcgcgcaggcggtcatttaagtctggtgtttaagcccggggctcaaccccggttcgcatcggaaactggatgacttgagtgtargagaggaaagtggaattccacgtgtagcggtgaaatgcgtagagatgtggaggaacaccagtggcgaaggcgactttctggcytataactgacgctgaggcgcgaaagcgtggggagcaaacaggattagataccctggtagtccacgccgtaaacgatgcatactaggtgtcggggattcgatttctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatcccgatgtaacgcctagagataggcgccctcttcggagcattggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggtcggtacaacgggaagcgaagccgcgaggtggagccaatccttataagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6372 - DNA, 1640 bp, Paenibacillus sp. Soil787
  ref <308>: DATABASE ACCESSION NUMBER: NCBI ACCESSION: NZ_LMSP01000047.1
  ref <309>: DATABASE ENTRY DATE: 2019-04-01
  ref <313>: RELEVANT RESIDUES IN SEQ ID NO: (1)..(1640)
ttatggagagtttgatcctggctcaggacgaacgctggcggcgtgcctaatacatgcaagtcgagcggatttatccttcgggataatctattatggagagtttgatcctggctcaggacgaacgctggcggcgtgcctaatacatgcaagtcgagcggatttatccttcgggataagttagcggcggacgggtgagtaacacgtaggtaacctgcctataagayygggataactatcggaaacgatagctaagaccggataactggttttctcgcatgagagaatcatgaaacacggagcaatctgtggcttatagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcawgrrgagtaactgcyctwtgtgtgacggtataggagaagaaagccccggctaactacgtgccagcagccgcggtaatacgtagggggcaagcgttgtccggaattattgggcgtaaagcgcgcgcaggcggtcaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgtyggggattcgattcctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatctgggtgtaagcactagagatagtgcccctcttcggagcacccaagacaggtggtgcatggttgtcgtcagctcgtgtcgtgagatgttgggttaagtcccgcaacgagcgcaacccttgatcttagttgccagcacttygggtgggcactctaagatgactgccggtgacaaaccggaggaaggtggggatgacgtcaaatcatcatgccccttatgacctgggctacacacgtactacaatggtcggtacaacgggaagcgaagccgcgaggcggagccaatccttataagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6373 - DNA, 1193 bp, Paenibacillus sp. TCA20
  ref <308>: DATABASE ACCESSION NUMBER: NCBI ACCESSION: NZ_BBIW01000032.1
  ref <309>: DATABASE ENTRY DATE: 2019-04-01
  ref <313>: RELEVANT RESIDUES IN SEQ ID NO: (1)..(1193)
tgggataactaccggaaacggtagctaataccggataggttcttctctcgcatgggaggagaaagaaagacggagcaatctgtcacttatggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcttagagtaactgctaagagagtgacggtacctgagaagaaagccccggctaactacgtgccagcagccgcggtaatacgtagggggcaagcgttgtccggaattattgggcgtaaagcgcgcgcaggcggtcatttaagttgggtgtttaaccccagggctcaaccctgggtcgcacccaaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtacctttccttcgggacattcaagacaggtggtgcatggttgtcgtcagctcgtgtcgtgagatgttgggttaagtcccgcaacgagcgcaacccttgatcttagttgccagcaggttaaggctgggcactctaaggtgactgccggtgacaaaccggaggaaggtggggatgacgtcaaatcatcatgccccttatgacctgggctacacacgtactacaatggccagtacaacgggaagcgaagccgcgaggtggagccaatcctaaaaagctggtctcagttcggattgcaggctgcaactcgcct

SEQ ID NO: 6374 - DNA, 1564 bp, Paenibacillus sp. TI45-13ar
  ref <308>: DATABASE ACCESSION NUMBER: NCBI ACCESSION: NZ_MDER01000079.1
  ref <309>: DATABASE ENTRY DATE: 2019-04-01
  ref <313>: RELEVANT RESIDUES IN SEQ ID NO: (1)..(1564)
tttatggagagtttgatcctggctcaggacgaacgctggcggcgtgcctaatacatgcaagtcgagcggagttgatgagaagcttgcttctcggatacttagcggcggacgggtgagtaacacgtaggcaacctgccctcaagcttgggacaactaccggaaacggtagctaataccgaatacatgatttgttcgcctgaacgaatttggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtccgatagagtaactgctatcggagtgacggtacctgagaagaaagccccggctaactacgtgccagcagccgcggtaatacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctttgaccggactagagatagtcttttccttcgggacaaaggagacaggtggtgcatggttgtcgtcagctcgtgtcgtgagatgttgggttaagtcccgcaacgagcgcaacccttatgcttagttgccagcacatcatggtgggcactctaagcagactgccggtgacaaaccggaggaaggtggggatgacgtcaaatcatcatgccccttatgacttgggctacacacgtactacaatggccggtacaacgggaagcaatatcgcaagatggagccaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaacctgcaaaggagccagccgccgaaggtggggtagatgattggggtgaagtcgtaacaaggtagccgtatcggaaggtgcggctggatcacctcctttctatggaga

SEQ ID NO: 6375 - DNA, 326 bp, Paenibacillus sp. UNC217MF
  ref <308>: DATABASE ACCESSION NUMBER: NCBI ACCESSION: NZ_KK366029.1
  ref <309>: DATABASE ENTRY DATE: 2019-04-01
  ref <313>: RELEVANT RESIDUES IN SEQ ID NO: (1)..(326)
tttaacggagagtttgatcctggctcaggacgaacgctggcggcgtgcctaatacatgcaagtcgagcggacttgaaggagtgcttgcactcctgatagttagcggcggacgggtgagtaacacgtaggtaacctgcccataagactgggataacccacggaaacgtgagctaataccagataggcattttcttcgcatgagggagatgagaaaggcggagcaatctgccacttatggatggacctgcggcgcattagctagttggtaaggtaacggcttaccaaggcgacgatgcgtagccgacctgagagggtgatcggccaca

SEQ ID NO: 6376 - DNA, 803 bp, Paenibacillus sp. UNCCL117
  ref <308>: DATABASE ACCESSION NUMBER: NCBI ACCESSION: NZ_FPIU01000001.1
  ref <309>: DATABASE ENTRY DATE: 2019-04-01
  ref <313>: RELEVANT RESIDUES IN SEQ ID NO: (1)..(803)
tgacttacagatgggcctgcggcgcattagctagttggcggggtaacggcccaccaaggcgacgatgcgtagccgacctgagagggtgatcggccacactgggactgagacacggcccagactcctacgggaggcagcagtagggaatcttccgcaatgggcgcaagcctgacggagcaacgccgcgtgagtgatgaaggttttcggatcgtaaagctctgttgccaaggaagaacgcctgggagagtaactgctcctagggtgacggtacttgagaagaaagccccggctaactacgtgccagcagccgcggtaatacgtagggggcaagcgttgtccggaattattgggcgtaaagcgcgcgcaggcggtcttttaagtctggtgtttaagcccggggctcaaccccggttcgcatcggaaactggaagacttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacaggattagataccctggtagtccacgccgtaaacgatgagtgctaggtgttaggggtttcgatacccttggtgccgaagtcaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctctgaccggtctagagatag

SEQ ID NO: 6377 - DNA, 325 bp, Paenibacillus sp. UNCCL52
  ref <308>: DATABASE ACCESSION NUMBER: NCBI ACCESSION: NZ_JMLR01000017.1
  ref <309>: DATABASE ENTRY DATE: 2019-04-01
  ref <313>: RELEVANT RESIDUES IN SEQ ID NO: (1)..(325)
ttaatggagagtttgatcctggctcaggacgaacgctggcggcgtgcctaatacatgcaagtcgagcggggttgattagaagcttgcttctaatcaacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccaca

SEQ ID NO: 6378 - DNA, 231 bp, Paenibacillus sp. URHA0014
  ref <308>: DATABASE ACCESSION NUMBER: NCBI ACCESSION: NZ_JIAZ01000025.1
  ref <309>: DATABASE ENTRY DATE: 2019-04-01
  ref <313>: RELEVANT RESIDUES IN SEQ ID NO: (1)..(231)
ctactatggagagtttgatcctggctcaggacgaacgctggcggcgtgcctaatacatgcaagtcgagcgggtttatccttcgggataagctagcggcggacgggtgagtaacacgtaggtaacctgcctttaagactgggataactatcggaaacgatagctaagaccggataactggttttctcgcatgagagaatcataaaacacggagcaatctgtgacttaaagat

SEQ ID NO: 6379 - DNA, 1464 bp, Paenibacillus sp. VKM B-2647
  ref <308>: DATABASE ACCESSION NUMBER: NCBI ACCESSION: NZ_JXAK01000144.1
  ref <309>: DATABASE ENTRY DATE: 2019-04-01
  ref <313>: RELEVANT RESIDUES IN SEQ ID NO: (1)..(1464)
ttagcggcggacgggtgagtaacacgtaggcaacctgcctgtaagaccgggataactaccggaaacggtagctaagaccggatagctggtcttctcgcatgagaggatcatgaaacacggggcaacctgtggcttacggatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgaggaaggtcttcggatcgtaaagctctgttgccctagacgaacgtctccgggagtaactgcccggagagtgacggtataggagaagaaagccccggctaactacgtgccagcagccgcggtaatacgtagggggcaagcgttgtccggaattattgggcgtaaagcgcgcgcaggcggtttcttaagtcttctgtttaatgcatgggctcaacccgtgtacgcagaggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgagtgctaggtgttaggggtttcgatacccttggtgccgaagtcaacacagtaagcactccgcctggggagtacgctcgcaagagtgaaactcaaaggaattgacggggacccgcacaagcagtggagtatgtggtttaattcgaagcaacgcgaagaaccttaccaggtcttgacatccccctgaccggcgcagagatgtgcctttccttcgggacaggggagacaggtggtgcatggttgtcgtcagctcgtgtcgtgagatgttgggttaagtcccgcaacgagcgcaacccttgatgctagttgccagcgagtaaagtcgggcactctaggatgactgccggtgacaaaccggaggaaggtggggatgacgtcaaatcatcatgccccttatgacctgggctacacacgtactacaatggccgttacaaagggaagcgaggccgcgaggcggagcgaatctcagaaaggcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggggccagccgccgaaggtggggtagatgattggggtgaagtcgtaacaaggtagccgtatcggaaggtgcggctggatcacctcctttctatggaga

SEQ ID NO: 6380 - DNA, 881 bp, Paenibacillus sp. VT-16-81
  ref <308>: DATABASE ACCESSION NUMBER: NCBI ACCESSION: NZ_MWZC01000282.1
  ref <309>: DATABASE ENTRY DATE: 2019-04-01
  ref <313>: RELEVANT RESIDUES IN SEQ ID NO: (1)..(881)
tggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacaaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6381 - DNA, 1563 bp, Paenibacillus sp. VT-400
  ref <308>: DATABASE ACCESSION NUMBER: NCBI ACCESSION: NZ_LELF01000062.1
  ref <309>: DATABASE ENTRY DATE: 2019-04-01
  ref <313>: RELEVANT RESIDUES IN SEQ ID NO: (1)..(1563)
tttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagtttgggacaactaccggaaacggtagctaataccgaataattgttttcttcgcctgaagaaaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcgatgcagagatgtatctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 6382 - DNA, 331 bp, Paenibacillus sp. ov031
  ref <308>: DATABASE ACCESSION NUMBER: NCBI ACCESSION: NZ_FRDO01000002.1
  ref <309>: DATABASE ENTRY DATE: 2019-04-01
  ref <313>: RELEVANT RESIDUES IN SEQ ID NO: (1)..(331)
ctttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagtttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgg

SEQ ID NO: 6383 - DNA, 1560 bp, Paenibacillus stellifer
  ref <308>: DATABASE ACCESSION NUMBER: NCBI ACCESSION: NZ_CP009286.1
  ref <309>: DATABASE ENTRY DATE: 2019-04-01
  ref <313>: RELEVANT RESIDUES IN SEQ ID NO: (1)..(1560)
tggagagtttgatcctggctcaggacgaacgctggcggcgtgcctaatacatgcaagtcgagcggagttatgaaggagcttgctctggattaacttagcggcggacgggtgagtaacacgtaggcaacctgcccttcagactgggataactaccggaaacggtagctaataccggataattcctttcttcgcctgaaggaaggatgaaagacggagcaatctgttgctgagggatgggcctgcggcgcattagctagttggtggggtaacggctcaccaaggcaacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgttctctagagtaactgctagagaagtgacggtacctgagaagaaagccccggctaactacgtgccagcagccgcggtaatacgtagggggcaagcgttgtccggaattattgggcgtaaagcgcgcgcaggcggcgatttaagtctggtgtttaaaccatgggctcaacctgtggtcgcatcggaaactggatggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccccctgaatacgttagagatagcgtaggccttcgggacaggggagacaggtggtgcatggttgtcgtcagctcgtgtcgtgagatgttgggttaagtcccgcaacgagcgcaacccttgactttagttgccagcaggtcaggctgggcactctagagtgactgccggtgacaaaccggaggaaggtggggatgacgtcaaatcatcatgccccttatgacctgggctacacacgtactacaatggccggtacaacgggaagcgaaaccgcgaggtggagccaatcttataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6384 - DNA, 1570 bp, Paenibacillus swuensis
  ref <308>: DATABASE ACCESSION NUMBER: NCBI ACCESSION: NZ_CP011388.1
  ref <309>: DATABASE ENTRY DATE: 2019-04-01
  ref <313>: RELEVANT RESIDUES IN SEQ ID NO: (1)..(1570)
atcctattatggagagtttgatcctggctcaggacgaacgctggcggcgtgcctaatacatgcaagtcgagcggagttgatgagaagcttgcttctctgatgctcagcggcggacgggtgagtaacacgtaggtaacctgcctgtaagatcgggataactaccggaaacggtagctaagaccggatacacggttctcttgcatgagaggattgggaaaagcggagcaatctgctgcttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccgaggagagtaactgctcttcgggtgacggtacctgagaagaaagccccggctaactacgtgccagcagccgcggtaatacgtagggggcaagcgttgtccggaattattgggcgtaaagcgcgcgcaggcggttttgtaagtctagtgtttaattccagggctcaaccctggatcgcaccggaaactgcaagacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccaggtcttgacatccctctgaatacgctggagacagcgtaggccttcgggacagaggagacaggtggtgcatggttgtcgtcagctcgtgtcgtgagatgttgggttaagtcccgcaacgagcgcaacccttgatcttagttgccagcgagtcaagtcgggcactctaggatgactgccggtgacaaaccggaggaaggtggggatgacgtcaaatcatcatgccccttatgacctgggctacacacgtactacaatggccggtacaacgggaagcgaagccgcgaggtggagccaatcttataaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6385 - DNA, 267 bp, Paenibacillus taiwanensis
  ref <308>: DATABASE ACCESSION NUMBER: NCBI ACCESSION: NZ_AULE01000002.1
  ref <309>: DATABASE ENTRY DATE: 2019-04-01
  ref <313>: RELEVANT RESIDUES IN SEQ ID NO: (1)..(267)
tttaatggagagtttgatcctggctcaggacgaacgctggcggcgtgcctaatacatgcaagtcgagcggagttgatgaggtgcttgcacctctgatgcttagcggcggacgggtgagtaacacgtaggtaacctgcctgtaagactgggataacccacggaaacgtgagctaataccggataggcgagactcccgcatgggagattcgagaaaggcggagcaatctgccacttacagatggacctgcggcgcattagctagttggt

SEQ ID NO: 6386 - DNA, 1363 bp, Paenibacillus terrae
  ref <308>: DATABASE ACCESSION NUMBER: NCBI ACCESSION: NZ_JTHP01000163.1
  ref <309>: DATABASE ENTRY DATE: 2019-04-01
  ref <313>: RELEVANT RESIDUES IN SEQ ID NO: (1)..(1363)
agaggaggaaagacggagcaatctgtcactgatggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgatcggtctagagatagatctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaagagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6387 - DNA, 263 bp, Paenibacillus terrigena
  ref <308>: DATABASE ACCESSION NUMBER: NCBI ACCESSION: NZ_KB895412.1
  ref <309>: DATABASE ENTRY DATE: 2019-04-01
  ref <313>: RELEVANT RESIDUES IN SEQ ID NO: (1)..(263)
tggagagtttgatcctggctcaggacgaacgctggcggcgtgcctaatacatgcaagtcgagcggagttattccttcgggaataacttagcggcggacgggtgagtaacacgtaggcaacctgcctgtaagatcgggataactaccggaaacggtagctaagaccgaataatcaacttggtcgcatgatcgagctgggaaaagcggagcaatctgctacttacagatgggcctgcggcgcattagctagttggtggggtaacg

SEQ ID NO: 6388 - DNA, 213 bp, Paenibacillus tyrfis
  ref <308>: DATABASE ACCESSION NUMBER: NCBI ACCESSION: NZ_JNVM01000025.1
  ref <309>: DATABASE ENTRY DATE: 2019-04-01
  ref <313>: RELEVANT RESIDUES IN SEQ ID NO: (1)..(213)
tttaatggagagtttgatcctggctcaggacgaacgctggcggcgtgcctaatacatgcaagtcgagcggacccttcggggttagcggcggacgggtgagtaacacgtaggcaacctgcctgtaagactgggataactaccggaaacggtagctaagaccggataagtgattctctcgcatgagagaatcaagaaacacggggcaacctgtgg

SEQ ID NO: 6389 - DNA, 962 bp, Paenibacillus wulumuqiensis
  ref <308>: DATABASE ACCESSION NUMBER: NCBI ACCESSION: NZ_LAQP01000037.1
  ref <309>: DATABASE ENTRY DATE: 2019-04-01
  ref <313>: RELEVANT RESIDUES IN SEQ ID NO: (1)..(962)
atttaagtctggtgtttaatcccgaagctcaacttcgggtcgcattggaaactggataacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgatcgatgcagagatgtatctttccttcgggacagaggagacaggtggtgcatggttgtcgtcagctcgtgtcgtgagatgttgggttaagtcccgcaacgagcgcaacccttatgcttagttgccagcacgttatggtgggcactctaagcagactgccggtgacaaaccggaggaaggtggggatgacgtcaaatcatcatgccccttatgacctgggctacacacgtactacaatggtcggtacaacgggaagcgaagccgcgaggtggagcgaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgccgaaggtggggtagatgattggggtgaagtcgtaacaaggtagccgtatcggaaggtgcggctggatcacctcctttctatggaga

SEQ ID NO: 6390 - DNA, 1565 bp, Paenibacillus wynnii
  ref <308>: DATABASE ACCESSION NUMBER: NCBI ACCESSION: NZ_JQCR01000001.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagtgattttgaaagcttgctttcaaaatcatttagcggcggacgggtgagtaacacgtaggcaacctgccccttagactgggataactaccggaaacggtagctaataccggataatttctttcctcacctgaggagagaatgaaagacggagcaatctgtcactgagggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgtaagcattagagatagtgcccctcttcggagcatcggagacaggtggtgcatggttgtcgtcagctcgtgtcgtgagatgttgggttaagtcccgcaacgagcgcaacccttatgcttagttgccagcacattatggtgggcactctaagcagactgccggtgacaaaccggaggaaggtggggatgacgtcaaatcatcatgccccttatgacctgggctacacacgtactacaatggccggtacaacgggctgcgaaatcgcaaggtggagcgaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 6391 - DNA, 736 bp, Paenibacillus zanthoxyli
  ref <308>: DATABASE ACCESSION NUMBER: NCBI ACCESSION: NZ_ASSD01000308.1
  ref <309>: DATABASE ENTRY DATE: 2019-04-01
  ref <313>: RELEVANT RESIDUES IN SEQ ID NO: (1)..(736)
accaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgttcttaagagtaactgcttaaggagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactgggcagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctga

SEQ ID NO: 6392 - DNA, 1294 bp, Paenirhodobacter enshiensis
  ref <308>: DATABASE ACCESSION NUMBER: NCBI ACCESSION: NZ_JFZB01000074.1
  ref <309>: DATABASE ENTRY DATE: 2019-04-01
  ref <313>: RELEVANT RESIDUES IN SEQ ID NO: (1)..(1294)
aagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattgaaaagttgggggtgaaatcccggggctcaacctcggaactgcctccaaaactatcagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggtgcgcatgcgtatcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccagagatggtttccttcagttcggctggatcccagacaggtgctgcatggctgtcgtcagctcgtgtcgtgagatgttcggttaagtccggcaacgagcgcaacccacactttcagttgccatcattcagttgggcactctggaagaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaaccagcaatggaggcagccagccacggtaggctcagtgactggggtgaagtcgtaacaaggtagccgtaggggaacctgcggctggatcacctcctttctaa

SEQ ID NO: 6393 - DNA, 1471 bp, Paenirhodobacter sp. MME-103
  ref <308>: DATABASE ACCESSION NUMBER: NCBI ACCESSION: NZ_BDDO01000048.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagatcttcgggtctagcggcggacgggtgagtaacacgtgggaacgtaccttttgctacggaatagcctcgggaaactgggagtaataccgtatgtgcccttcgggggaaagatttatcggcaaaagatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatatttaagtcgggggtgaaatcccggggctcaaccccggaactgccttcgatactggatgtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggtttccagagatggattccttcagttcggctggatcagtgacaggtgctgcatggctgtcgtcagctcgtgtcgtgagatgttcggttaagtccggcaacgagcgcaacccacacttccagttgccatcattcagttgggcactctggaagaactgccgatgataagtcggaggaaggtgtggatgacgtcaagtcctcatggcccttacgggttgggctacacacgtgctacaatggcagtgacaatgggttaatccctaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacctgtaaaggaggcagccagccacggtaggctcagtgactggggtgaagtcgtaacaaggtagccgtaggggaacctgcggctggatcacctcctttctaa

SEQ ID NO: 6394 - DNA, 1561 bp, Paenisporosarcina indica
  ref <308>: DATABASE ACCESSION NUMBER: NCBI ACCESSION: NZ_MPTA01000016.1
  ref <309>: DATABASE ENTRY DATE: 2019-04-01
  ref <313>: RELEVANT RESIDUES IN SEQ ID NO: (1)..(1561)
ctattatggagagtttgatcctggctcaggacgaacgctggcggcgtgcctaatacatgcaagtcgagcggaatgatgaagaagcttgcttcttctgattttagcggcggacgggtgagtaacacgtgggcaacctaccttgtagattgggataactccgggaaaccggggctaataccgaataatccattttgcttcatggcgaaatgttaaaaggcggctttcggctgtcactacgagatgggcccgcggcgcattagctagttggtagggtaacggcctaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacacgtacgagagtaactgctcgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtttagagataagcctttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggctgcaaacccgcgagggggagccaatcccataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 6395 - DNA, 435 bp, Paenisporosarcina quisquiliarum
  ref <308>: DATABASE ACCESSION NUMBER: NCBI ACCESSION: NZ_FOBQ01000006.1
  ref <309>: DATABASE ENTRY DATE: 2019-04-01
  ref <313>: RELEVANT RESIDUES IN SEQ ID NO: (1)..(435)
ttatggagagtttgatcctggctcaggacgaacgctggcggcatgcctaatacatgcaagtcgagcgaatgacgaagaagcttgcttcttctgatttagcggcggacgggtgagtaacacgtgggcaacctgccctgtagattgggataactccgggaaaccggggctaataccgaataatccatttcctcacatggggagatgttaaaagacggcatctcgctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatc

SEQ ID NO: 6396 - DNA, 823 bp, Paenisporosarcina sp. HGH0030
  ref <308>: DATABASE ACCESSION NUMBER: NCBI ACCESSION: NZ_KE150421.1
  ref <309>: DATABASE ENTRY DATE: 2019-04-01
  ref <313>: RELEVANT RESIDUES IN SEQ ID NO: (1)..(823)
tggagagtttgatcctggctcaggacgaacgctggcggcgtgcctaatacatgcaagtcgagcggaatgatgaagaagcttgcttcttctgattttagcggcggacgggtgagtaacacgtgggcaacctaccttgtagattgggataactccgggaaaccggggctaataccaaataatccattttgcttcatggcgaaatgttgaaaggcggcttcggctgtcactacgagatgggcccgcggcgcattagctagttggtagggtaacggcctaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacacgtacgagagtaactgctcgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaac

SEQ ID NO: 6397 - DNA, 1556 bp, Paenisporosarcina sp. K2R23-3
  ref <308>: DATABASE ACCESSION NUMBER: NCBI ACCESSION: NZ_CP032418.1
  ref <309>: DATABASE ENTRY DATE: 2019-04-01
  ref <313>: RELEVANT RESIDUES IN SEQ ID NO: (1)..(1556)
atgatggagagtttgatcctggctcaggacgaacgctggcggcgtgcctaatacatgcaagtcgagcggaaagaagaagaagcttgcttcttctgattttagcggcggacgggtgagtaacacgtgggcaacctgccctgtagattgggataactccgggaaaccggggctaataccgaataatccttcgaatttcatgatttgaagttgaaagacggtctcggctgtcactacaggatgggcccgcggcgcattagctagttggtagggtaacggcctaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtgagggaagaacaggtaggggagtaactgtccttactatgacggtacctcattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggcatagagatatgcttttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagggttgcgaacccgtgagggggagctaatcccataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 6398 - DNA, 1559 bp, Paenisporosarcina sp. OV554
  ref <308>: DATABASE ACCESSION NUMBER: NCBI ACCESSION: NZ_QBUC01000070.1
  ref <309>: DATABASE ENTRY DATE: 2019-04-01
  ref <313>: RELEVANT RESIDUES IN SEQ ID NO: (1)..(1559)
attatggagagtttgatcctggctcaggacgaacgctggcggcgtgcctaatacatgcaagtcgagcggaatgatgaagaagcttgcttcttctgattttagcggcggacgggtgagtaacacgtgggcaacctaccttgtagattgggataactccgggaaaccggggctaataccgaataatccattttgcttcatggcaagatgttgaaaggcggcttcggctgtcactacgagatgggcccgcggcgtattagctagttggtagggtaatggcctaccaaggcgacgatacgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacacgtacgagagtaactgctcgtaccttgacggtaccttattagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccactgaccggcttagagataggcttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggctgcaaacccgcgagggggagccaatcccataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaacctttacaggagccagccgccgaaggtgggacagatgattggggtgaagtcgtaacaaggtagccgtatcggaaggtgcggctggatcacctcctttcta

SEQ ID NO: 6399 - DNA, 1553 bp, Paenisporosarcina sp. TG-14
  ref <308>: DATABASE ACCESSION NUMBER: NCBI ACCESSION: NZ_AMGD01000102.1
  ref <309>: DATABASE ENTRY DATE: 2019-04-01
  ref <313>: RELEVANT RESIDUES IN SEQ ID NO: (1)..(1553)
tattatggagagtttgatcctggctcaggacgaacgctggcggcgtgcctaatacatgcaagtcgagcggagagaagaagcttgcttcttctcttagcggcggacgggtgagtaacacgtgggcaacctaccttgtagattgggataactccgggaaaccggggctaataccaaataatccattttgcttcatggcgaaatgttgaaaggcggcttcggctgtcactacaagatgggcccgcggcgtattagctagttggtagggtaatggcctaccaaggcgacgatacgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacacgtacgagagtaactgctcgtaccttgacggtaccttattagaaagccacggctaactacgtgccagcagccgcggtaatacgtaggtggcaagcgttgtccggaattattgggcgtaaagcgcgcgcaggcggtcctttaagtccgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtttagagataagcctttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacgatacaaagggctgcaaacccgcgagggggagccaatcccataaaatcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6400 - DNA, 1074 bp, Paenisporosarcina sp. TG20
  ref <308>: DATABASE ACCESSION NUMBER: NCBI ACCESSION: NZ_ALJG01000052.1
  ref <309>: DATABASE ENTRY DATE: 2019-04-01
  ref <313>: RELEVANT RESIDUES IN SEQ ID NO: (1)..(1074)
ccttgacggtaccttattagaaagccacggctaactacgtgccagcagccgcggtaatacgtaggtggcaagcgttgtccggaattattgggcgtaaagcgcgcgcaggcggtcctttaagtccgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggcttagagataggtctttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacgatacaaagggctgcaaacccgcgagggggagccaatcccataaaatcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttattggagccagccgccgaaggtgggacagatgattggggtgaagtcgtaacaaggtagccgtatcggaaggtgcggctggatcacctcctttctaa

SEQ ID NO: 6401 - DNA, 1466 bp, Palleronia abyssalis
  ref <308>: DATABASE ACCESSION NUMBER: NCBI ACCESSION: NZ_ONZF01000036.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcctaacacatgcaagtcgagcgcaccttcgggtgagcggcggacgggtgagtaacacgtgggaacgtacccattcctgcgggatagcctctggaaacggagagtaataccgcatacgcccttcgggggaaagatttatcggggatggatcggcccgcgtctgattaggtagttggtggggtaatggcctaccaagcctacgatcagtagctggtttgagaggatgatcagccacactgggactgagacacggcccagactcctacgggaggcagcagtggggaatcttagacaatgggcgcaagcctgatctagccatgccgcgtgagtgacgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgcgcgtaggcggacatttaagtcaggggtgaaatcccggggctcaaccccggaactgcccttgatactgggtgtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgtagttccgagagatcggttcgtcagttcggctggatatcacacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgggttaatcccaaaaagatgtctcagttcggattgtcgtctgcaactcgacggcatgaagtcggaatcgctagtaatcgtggaacagcatgccacggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 6402 - DNA, 1473 bp, Palleronia marisminoris
  ref <308>: DATABASE ACCESSION NUMBER: NCBI ACCESSION: NZ_FWFV01000023.1
  ref <309>: DATABASE ENTRY DATE: 2019-04-01
  ref <313>: RELEVANT RESIDUES IN SEQ ID NO: (1)..(1473)
tcaacttgagagtttgatcctggctcagaacgaacgctggcggcaggcctaacacatgcaagtcgagcgcacctttcggggtgagcggcggacgggtgagtaacacgtgggaacgtacccttctctgcgggatagccactggaaacggtgagtaataccgcatacgcccttcgggggaaagatttatcggggaaggatcggcccgcgtctgattaggtagttggtggggtaacggcctaccaagcctacgatcagtagctggtttgagaggatgaccagccacactgggactgagacacggcccagactcctacgggaggcagcagtggggaatcttagacaatgggggcaaccctgatctagccatgccgcgtgagtgacgaaggccttagggtcgtaaagctctttcgccggggaagataatgactgtacccggtaaagaagtcccggctaactccgtgccagcagccgcggtaatacggaggggactagcgttgttcggaattactgggcgtaaagcgcgcgtaggcggactattaagtcaggggtgaaatcccggggctcaaccccggaactgcccttgatactggtagtctggagttctggagaggtgagtggaattccgagtgtagaggtgaaattcgtagatattcggaggaacaccagtggcgaaggcggctcactggccagatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgtactttcgggagaccgatcggtcagttcggctggatatcacacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgggttaatcccaaaaagatgtctcagttcggattgtcgtctgcaactcgacggcatgaagtcggaatcgctagtaatcgtggaacagcatgccacggtgaatacgttcccgggccttgtacacaccgcccgtcacaccatgggagttggttttacccgacgacggtgcgctaacccttcggggaggcagccggccacggtaagatcagcgactggggtgaagtcgtaacaaggtagccgtaggggaacctgcggctggatcacctcctttctaagg

SEQ ID NO: 6403 - DNA, 1551 bp, Paludifilum halophilum
  ref <308>: DATABASE ACCESSION NUMBER: NCBI ACCESSION: NZ_NOWF01000029.1
  ref <309>: DATABASE ENTRY DATE: 2019-04-01
  ref <313>: RELEVANT RESIDUES IN SEQ ID NO: (1)..(1551)
ggagagtttgatcctggctcaggacgaacgctggcggcgtgcctaatacatgcaagtcgagcggaccgaaggggagcttgctccctggaggtcagcggcggacgggtgagtaacacgtgggcaacctgcccgcaagtccgggataaccccgggaaaccggagctaataccggatattcccattgtctcacctggggcgatggggaaaggcggcttaggctgtcacttgcggatgggcccgcggcgcattagctggttggtggggtaacggcctaccaaggcgacgatgcgtagccgacctgagagggtgaccggccacactgggactgagacacggcccagactcctacgggaggcagcagtagggaattttccgcaatgggcgaaagcctgacggagcaacgccgcgtgagtgaggacggctttcgggttgtaaagctctgttctccgggaagaacggcgggaggttgaagaagccttttgcatgacggtaccggagaagaaagccccggctaactacgtgccagcagccgcggtaatacgtagggggcgagcgttgtccggaattattgggcgtaaagcgcgcgcaggcggcctgttaagtctggtgtgaaagaccgcggctcaaccgtgggggtgcatcagaaactggcaggcttgagtgcaggagaggggagcggaattcccggtgtagcggtggaatgcgtagagatcgggaggaacaccagtggcgaaggcggctctctggcctgtaactgacgctgaggcgcgaaagcgtggggagcgaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgtagagatacaccttcccttcggggcagcggagacaggtggtgcatggttgtcgtcagctcgtgtcgtgagatgttgggttcagtcccgcaacgagcgcaacccttatctttagttgccagcacgtcaaggtgggcactctagagagacagccggtgaaagccggaggaaggtggggatgacgtcaaatcatcatgccccttatgccctgggcgacacacgtgctacaatggctggtacaacgggaagcgaagccgtgaggtgaagccaatccccaaaaaccagtctcagttcggatcgcaggctgcaacccgcctgcgtgaagctggaatcgctagtaatcgcggatcagcatgccgcggtgaatccgttcccgggccttgtacacaccgcccgtcacaccacgagagtttgcaacacccgaagtcggtgagggaaccctttgggacccagccgccgaaggtggggcaaatgattggggtgaagtcgtaacaaggtatccctaccggaaggtggggatggatcacctcctttcta

SEQ ID NO: 6404 - DNA, 1525 bp, Paludisphaera borealis
  ref <308>: DATABASE ACCESSION NUMBER: NCBI ACCESSION: NZ_CP019082.1
  ref <309>: DATABASE ENTRY DATE: 2019-04-01
  ref <313>: RELEVANT RESIDUES IN SEQ ID NO: (1)..(1525)
atcatgaagggtttgatcctggctcagaatgaacgttggcggcgtggattaggcatgcaagtcgaacgggtccggcttcggccgggccagtggcggaagggtgagtaaggcgacggcaaccaaccccgaggttgggtatagccgcgggaaactgcgggtaatccccagcgacgtgacgacgccggcatcggcgtttcaccaaaggcttcggccgccttgggacgggccgtcgtggtattaggtagttggcggggttacggcccaccaagccgatgatgcctaccgggcgtgcgagcgtggcccggcacactgggactgagacactgcccagactcttacgggaggctgcagtcgagaatcttcggcaatgggcgcaagcctgaccgagcgacgccgcgtggaggatgaaggccttcgggttgtaaactcctgtcgagggggaggaaggggcaaccttgaccgatccctggaggaagcacgggctaagttcgtgccagcagccgcggtaagacgaaccgtgcgaacgttattcggaatcactgggcttaaagcgcgtgtaggcggatgggtgcgtcggcttctgaaagcccccggctcaaccggggaagtggggccgaaacgacccgtctggagggacgtagggggatctggaacttccggtggagcggtgaaatgcgttgagatcggaaggaacgcccgtggcgaaagcgagatcctggacgttttctgacgctgagacgcgaaagctaggggagcaaacgggattagataccccggtagtcctagccgtaaacgatgagcactaggtagggggctcgccgatgggctctctgccgtagggaaaccgtgaagtgctccgcctggggagtatggtcgcaaggctgaaactcaaaggaattgacgggggctcacacaagcggtggagcatgtggcttaattcgaggctacgcgaaaaaccttatcctgggcttgacatgcagggattagccggcggaaacgtcggtgacgccgcaaggtggaacctgtgcaggtgctgcatggctgtcgtcagctcgtgccgtgaggtgttgggttaagtcccctaacgagcgcaacccctgtgactagttgccagcacgtaaaggtggggactctagtcagaccgccggcgtcaagccggaggaaggcggggacgacgtcaagtcatcatggcccttatgcccagggctgcacacgtgctacaatggggcggacaaagcgtcgccaggccgcaaggccgcgctaatcgcaaaaaccgctcctcagttcggattgcgggctgcaactcgcccgcatgaagctggaatcgctagtaatcgcggatcagcattgccgcggtgaatgtgttcctgagccttgtacacaccgcccgtcaagccaccaaagcggggggcatccgaagtcgtcggagccgaaaggcaggcgccgaagatgaaacccgtgatggggactaagtcgtaacaaggtaaccgtaggggaacctgcggttggatcacctcctttctaa

SEQ ID NO: 6405 - DNA, 1539 bp, Pandoraea apista
  ref <308>: DATABASE ACCESSION NUMBER: NCBI ACCESSION: NZ_RZMU01000076.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaatgtaccttgtagtgggggatagctcggcgaaagccggattaataccgcatacgctctgaggaggaaagcgggggaccttcgggcctcgcgctacaagagcagccgatgtcagattagctagttggtgaggtaaaagctcaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctctgggttaatacctcggggggatgacggtaccggaagaataagcaccggctaactacgtgccagcagccgcggtaatacgtagggtgcaagcgttaatcggaattactgggcgtaaagcgtgcgcaggcggttttgtaagacggatgtgaaatccccgggcttaacctgggaactgcattcgtgactgcaaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaatcctgctgagaggtgggagtgctcgaaagagaaccgtaacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggtacagagggtcgccaagccgcgaggtggagctaaccccagaaaaccgatcgtagtccggatcgcagtctgcaactcgactgcgtgaagctggaatcgctagtaatcgcggatcagcatgtcgcggtgaatacgttcccgggtcttgtacacaccgcccgtcacaccatgggagtgggttttgccagaagtaggtagcctaaccgtaaggagggcgcttaccacggcaggattcatgactggggtgaagtcgtaacaaggtagccgtaggggaacctgcggctggatcacctcctttctag

SEQ ID NO: 6406 - DNA, 1538 bp, Pandoraea sp. XY-2
  ref <308>: DATABASE ACCESSION NUMBER: NCBI ACCESSION: NZ_CP030849.1
  ref <309>: DATABASE ENTRY DATE: 2019-04-01
  ref <313>: RELEVANT RESIDUES IN SEQ ID NO: (1)..(1538)
ttaaactgaagagtttgatcctggctcagattgaacgctggcggcatgccttacacatgcaagtcgaacggcagcacgggtgcttgcacctggtggcgagtggcgaacgggtgagtaatacatcggaatgtaccttgtagtgggggatagctcggcgaaagccggattaataccgcatacgctctgaggaggaaagcgggggaccttcgggcctcgcgctacaagagcagccgatgtcagattagctagttggtggggtaaaagctcaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctctgggttaatacctcgggggatgacggtaccggaagaataagcaccggctaactacgtgccagcagccgcggtaatacgtagggtgcaagcgttaatcggaattactgggcgtaaagcgtgcgcaggcggttttgtaagacggatgtgaaatccccgggcttaacctgggaactgcattcgtgactgcaaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaatcctgctgagaggtgggagtgctcgaaagagaaccgtaacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggtacagagggctgccaaaccgcgaggtggagctaaccccagaaaaccgatcgtagtccggatcgcagtctgcaactcgactgcgtgaagctggaatcgctagtaatcgcggatcagcatgtcgcggtgaatacgttcccgggtcttgtacacaccgcccgtcacaccatgggagtgggttttgccagaagtaggtagcctaaccgtaaggagggcgcttaccacggcaggattcatgactggggtgaagtcgtaacaaggtagccgtaggggaacctgcggctggatcacctcctttctag

SEQ ID NO: 6407 - DNA, 1483 bp, Pannonibacter carbonis
  ref <308>: DATABASE ACCESSION NUMBER: NCBI ACCESSION: NZ_PUDR01000029.1
  ref <309>: DATABASE ENTRY DATE: 2019-04-01
  ref <313>: RELEVANT RESIDUES IN SEQ ID NO: (1)..(1483)
aacctgagagtttgatcctggctcagaacgaacgctggcggcaggcttaacacatgcaagtcgaacgccccgcaaggggagtggcagacgggtgagtaacgcgtgggaacataccctttggtgcggaacaacaactggaaacggttgctaataccgcatgagccctacgggggaaagatttatcgccaaaggattggcccgcgtcggattagctagttggtggggtaatggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaacctcggaactgcctttgatactggaagtcttgaggccgagagaggtgagtggaattccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggatgcatgcattttggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatccagagatggatggttctcttcggagacgccaggacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacaatgggcagcgaacccgcgagggggagctaatctcaaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttcta

SEQ ID NO: 6408 - DNA, 1498 bp, Pannonibacter indicus
  ref <308>: DATABASE ACCESSION NUMBER: NCBI ACCESSION: NZ_CYHE01000031.1
  ref <309>: DATABASE ENTRY DATE: 2019-04-01
  ref <313>: RELEVANT RESIDUES IN SEQ ID NO: (1)..(1498)
cttttgtttaacctgagagtttgatcctggctcagaacgaacgctggcggcaggcttaacacatgcaagtcgaacgccctggtaacggggagtggcagacgggtgagtaacacgtgggaacataccctttggtgcggaacaacagctggaaacggctgctaataccgcatgcgccctacgggggaaagatttatcgccgaaggattggcccgcgtctgattagctagttggtggggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaacctcggaactgcctttgatactgggagtctggagtccgggagaggtgagtggaactccgagtgtagaggtgaaattcgtagatattcggaagaacaccagtggcgaaggcggctcactggcccggtactgacgctgaggtgcgaaagcgtggggagcaaacaggattagataccctggtagtccacgccgtaaacgatggaagctagccgtcagggtgcatgcatcttggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctaccacgggagaccgtgggttcccttcggggacgccaggacaggtgctgcatggctgtcgtcagctcgtgtcgtgagatgttgggttaagtcccgcaacgagcgcaaccctcgcccttagttgccagcattgagttgggcactctagggggactgccggtgataagccgagaggaaggtggggatgacgtcaagtcctcatggcccttacgggctgggctacacacgtgctacaatggcggtgacagtgggcagcgaaggggcgacccggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggtggtgcgctaaccgcaaggaggcagccaaccacggtaggctcagcgactggggtgaagtcgtaacaaggtagccgtaggggaacctgcggctggatcacctcctttctaagga

SEQ ID NO: 6409 - DNA, 1548 bp, Pantoea agglomerans
  ref <308>: DATABASE ACCESSION NUMBER: NCBI ACCESSION: NZ_UGSM01000001.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatggggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6410 - DNA, 1088 bp, Pantoea agglomerans
ggttaataaccctgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6411 - DNA, 1088 bp, Pantoea agglomerans; identical to SEQ ID NO: 6410

SEQ ID NO: 6412 - DNA, 1088 bp, Pantoea agglomerans; identical to SEQ ID NO: 6410

SEQ ID NO: 6413 - DNA, 656 bp, Pantoea allii
cggccgcaaggttaaaactcaaatgaattgacgggggcccgcacaagcggtggagcatgtggtttaattcgatgcaacgcgaagaaccttacctactcttgacatccagcgaacttggcagagatgctttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6414 - DNA, 1459 bp, Pantoea allii
  ref <308>: DATABASE ACCESSION NUMBER: NCBI ACCESSION: NZ_RBXY01000008.1
  ref <309>: DATABASE ENTRY DATE: 2019-04-01
  ref <313>: RELEVANT RESIDUES IN SEQ ID NO: (1)..(1459)
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6415 - DNA, 1019 bp, Pantoea allii
aaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgc

SEQ ID NO: 6416 - DNA, 1546 bp, Pantoea brenneri
  ref <308>: DATABASE ACCESSION NUMBER: NCBI ACCESSION: NZ_MIEI01000169.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcggacggtagcacagggagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6417 - DNA, 846 bp, Pantoea deleyi
  ref <308>: DATABASE ACCESSION NUMBER: NCBI ACCESSION: NZ_MIPO01000260.1
  ref <309>: DATABASE ENTRY DATE: 2019-04-01
  ref <313>: RELEVANT RESIDUES IN SEQ ID NO: (1)..(846)
aaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggcctcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggag

SEQ ID NO: 6418 - DNA, 1548 bp, Pantoea dispersa
  ref <308>: DATABASE ACCESSION NUMBER: NCBI ACCESSION: NZ_ML137047.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6419 - DNA, 1550 bp, Pantoea eucrina
  ref <308>: DATABASE ACCESSION NUMBER: NCBI ACCESSION: NZ_MIPP01000087.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcggacggtagcacaggggagcttgctccttgggtgacgagtggcggacgggtgagtaatgtctgggaaactgcccggtggagggggataactactggaaacggtagctaataccgcataacgtcttcggaccaaagtgggggatcttcgggacctcacgccaccggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgggtaatgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaa

SEQ ID NO: 6420 - DNA, 1549 bp, Pantoea sp. 3 1284
  ref <308>: DATABASE ACCESSION NUMBER: NCBI ACCESSION: NZ_QNVM01000046.1
  ref <309>: DATABASE ENTRY DATE: 2019-04-01
  ref <313>: RELEVANT RESIDUES IN SEQ ID NO: (1)..(1549)
aaattgaagagtttgatcatggctcagattgaacgctggcggcaggcctaacacatgcaagtcggacggtagcacagaggagcttgctccttgggtgacgagtggcggacgggtgagtaatgtctgggaaactgcccggtggagggggataactactggaaacggtagctaataccgcataacgtcttcggaccaaagtgggggaccttagggcctcacgccaccggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgggtaatgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaa

SEQ ID NO: 6421 - DNA, 1546 bp, Pantoea sp. 596
  ref <308>: DATABASE ACCESSION NUMBER: NCBI ACCESSION: NZ_PJRT01000022.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgaacggtagcacagagagcttgctctcgggtgacgagtggcggacgggtgagtaacgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaatagcttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6422 - DNA, 214 bp, Pantoea sp. AG1095
  ref <308>: DATABASE ACCESSION NUMBER: NCBI ACCESSION: NZ_QKMJ01000013.1
  ref <309>: DATABASE ENTRY DATE: 2019-04-01
  ref <313>: RELEVANT RESIDUES IN SEQ ID NO: (1)..(214)
aaattgaagagtttgatcatggctcagattgaacgctggcggcaggcctaacacatgcaagtcgaacggtagcacagagagcttgctctcgggtgacgagtggcggacgggtgagtaacgtctgggaaactgcccgatggagggggataactactggaaacggtagctaataccgcataacgtcgcaagaccaaagtgggggaccttcgggcct

SEQ ID NO: 6423 - DNA, 1546 bp, Pantoea sp. AG702
  ref <308>: DATABASE ACCESSION NUMBER: NCBI ACCESSION: NZ_QGTU01000020.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6424 - DNA, 1459 bp, Pantoea sp. AMG 501
  ref <308>: DATABASE ACCESSION NUMBER: NCBI ACCESSION: NZ_NIRH01000031.1
  ref <309>: DATABASE ENTRY DATE: 2019-04-01
  ref <313>: RELEVANT RESIDUES IN SEQ ID NO: (1)..(1459)
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccasrgaaytyrgcagagatgcyttrgtgccttcgggaacystgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6425 - DNA, 590 bp, Pantoea sp. ARC270
  ref <308>: DATABASE ACCESSION NUMBER: NCBI ACCESSION: NZ_PUGA01000091.1
  ref <309>: DATABASE ENTRY DATE: 2019-04-01
  ref <313>: RELEVANT RESIDUES IN SEQ ID NO: (1)..(590)
aaattgaagagtttgatcatggctcagattgaacgctggcggcaggcctaacacatgcaagtcggacggtagcacagagagcttgctcttgggtgacgagtggcggacgggtgagtaatgtctggggatctgcccgatagagggggataaccactggaaacggtggctaataccgcataatgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctg

SEQ ID NO: 6426 - DNA, 929 bp, Pantoea sp. ARC607
  ref <308>: DATABASE ACCESSION NUMBER: NCBI ACCESSION: NZ_PUFZ01000185.1
  ref <309>: DATABASE ENTRY DATE: 2019-04-01
  ref <313>: RELEVANT RESIDUES IN SEQ ID NO: (1)..(929)
taacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaa

SEQ ID NO: 6427 - DNA, 221 bp, Pantoea sp. AV62
  ref <308>: DATABASE ACCESSION NUMBER: NCBI ACCESSION: NZ_NHBE01000031.1
  ref <309>: DATABASE ENTRY DATE: 2019-04-01
  ref <313>: RELEVANT RESIDUES IN SEQ ID NO: (1)..(221)
acttaaattgaagagtttgatcatggctcagattgaacgctggcggcaggcctaacacatgcaagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctc

SEQ ID NO: 6428 - DNA, 1548 bp, Pantoea sp. B40
  ref <308>: DATABASE ACCESSION NUMBER: NCBI ACCESSION: NZ_BADG01000271.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcggacggtagcacaggggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6429 - DNA, 1548 bp, Pantoea sp. FDAARGOS 194
  ref <308>: DATABASE ACCESSION NUMBER: NCBI ACCESSION: NZ_NWFM02000004.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgtttccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6430 - DNA, 1552 bp, Pantoea sp. GM01
  ref <308>: DATABASE ACCESSION NUMBER: NCBI ACCESSION: NZ_AKIU01000040.1
  ref <309>: DATABASE ENTRY DATE: 2019-04-01
  ref <313>: RELEVANT RESIDUES IN SEQ ID NO: (1)..(1552)
acttaaattgaagagtttgatcatggctcagattgaacgctggcggcaggcctaacacatgcaagtcggacggtagcacagaggagcttgctccttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttagcagagatgctttggtgccttcgggaacgctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6431 - DNA, 1336 bp, Pantoea sp. ICBG 1758
  ref <308>: DATABASE ACCESSION NUMBER: NCBI ACCESSION: NZ_POWL01000016.1
  ref <309>: DATABASE ENTRY DATE: 2019-04-01
  ref <313>: RELEVANT RESIDUES IN SEQ ID NO: (1)..(1336)
cctcacgccaccggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgggtaatgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaa

SEQ ID NO: 6432 - DNA, 1548 bp, Pantoea sp. ICBG 828
  ref <308>: DATABASE ACCESSION NUMBER: NCBI ACCESSION: NZ_POWN01000022.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6433 - DNA, 1548 bp, Pantoea sp. ICBG 985
  ref <308>: DATABASE ACCESSION NUMBER: NCBI ACCESSION: NZ_POWM01000019.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6434 - DNA, 1548 bp, Pantoea sp. JKS000250
  ref <308>: DATABASE ACCESSION NUMBER: NCBI ACCESSION: NZ_QICZ01000001.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6435 - DNA, 1548 bp, Pantoea sp. LMG 27579
  ref <308>: DATABASE ACCESSION NUMBER: NCBI ACCESSION: NZ_JMEE01000019.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggtagcacagaagagcttgctcttcgggtgacgagtggcggacgggtgagtaatgtctggggatctgcccgatggagggggataactactggaaacggtagctaataccgcataacgtcgcaagaccaaagtgggggaccttcgggcctcacaccatcggatgaacccagatgagattagctagtaggtggggtaacggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagagaggttaataacctttttcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacccgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6436 - DNA, 1553 bp, Pantoea sp. OV426
  ref <308>: DATABASE ACCESSION NUMBER: NCBI ACCESSION: NZ_FOVG01000012.1
  ref <309>: DATABASE ENTRY DATE: 2019-04-01
  ref <313>: RELEVANT RESIDUES IN SEQ ID NO: (1)..(1553)
acttaaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6437 - DNA, 1548 bp, Pantoea sp. PNA 03-3
  ref <308>: DATABASE ACCESSION NUMBER: NCBI ACCESSION: NZ_QICO01000019.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6438 - DNA, 1078 bp, Pantoea sp. PSNIH3
  ref <308>: DATABASE ACCESSION NUMBER: NCBI ACCESSION: NZ_PQJW01000088.1
  ref <309>: DATABASE ENTRY DATE: 2019-04-01
  ref <313>: RELEVANT RESIDUES IN SEQ ID NO: (1)..(1078)
ccgtcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccctagtgccttcgggaaccgtgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaagct

SEQ ID NO: 6439 - DNA, 1078 bp, Pantoea sp. PSNIH4; identical to SEQ ID NO: 6438
  ref <308>: DATABASE ACCESSION NUMBER: NCBI ACCESSION: NZ_PQJZ01000068.1
  ref <309>: DATABASE ENTRY DATE: 2019-04-01
  ref <313>: RELEVANT RESIDUES IN SEQ ID NO: (1)..(1078)

SEQ ID NO: 6440 - DNA, 1078 bp, Pantoea sp. PSNIH5; identical to SEQ ID NO: 6438
  ref <308>: DATABASE ACCESSION NUMBER: NCBI ACCESSION: NZ_PQJX01000070.1
  ref <309>: DATABASE ENTRY DATE: 2019-04-01
  ref <313>: RELEVANT RESIDUES IN SEQ ID NO: (1)..(1078)

SEQ ID NO: 6441 - DNA, 1548 bp, Pantoea sp. PSNIH6
  ref <308>: DATABASE ACCESSION NUMBER: NCBI ACCESSION: NZ_PQJV01000050.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgaacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6442 - DNA, 1545 bp, Pantoea sp. RIT388
  ref <308>: DATABASE ACCESSION NUMBER: NCBI ACCESSION: NZ_RMVG01000054.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgaacggcagcacaggagagcttgctctccgggtggcgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtttccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttggcagagatgccttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaacgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 6443 - DNA, 1247 bp, Pantoea sp. RIT 413
  ref <308>: DATABASE ACCESSION NUMBER: NCBI ACCESSION: NZ_QBJB02000030.1
  ref <309>: DATABASE ENTRY DATE: 2019-04-01
  ref <313>: RELEVANT RESIDUES IN SEQ ID NO: (1)..(1247)
tgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgcttcggtgccttcgggaactctgagacaggtgctgcatggctgtcgtcagctcgtgttgtgaaatgttgggttaagtcccgcaacgagcgcaacccttatcctttgttgccagcgggtaatgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctcctt

SEQ ID NO: 6444 - DNA, 281 bp, Pantoea sp. VS1
  ref <308>: DATABASE ACCESSION NUMBER: NCBI ACCESSION: NZ_NHZE01000089.1
  ref <309>: DATABASE ENTRY DATE: 2019-04-01
  ref <313>: RELEVANT RESIDUES IN SEQ ID NO: (1)..(281)
gagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6445 - DNA, 1546 bp, Pantoea sp. YU22
  ref <308>: DATABASE ACCESSION NUMBER: NCBI ACCESSION: NZ_RYDU01000043.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgaacggcagcacagagagcttgctctcgggtggcgagtggcggacgggtgagtaatgtctggggatctgcccggtagagggggataaccactggaaacggtggctaataccgcataacgtcgcaagaccaaagagggggaccttcgggcctctcactatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggatggagcttaatacgcttcgtcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaacgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6446 - DNA, 1551 bp, Pantoea sp. aB
  ref <308>: DATABASE ACCESSION NUMBER: NCBI ACCESSION: NZ_AEDL01000029.1
  ref <309>: DATABASE ENTRY DATE: 2019-04-01
  ref <313>: RELEVANT RESIDUES IN SEQ ID NO: (1)..(1551)
acttaaattgaagagtttgatcatggctcagattgaacgctggcggcaggcctaacacatgcaagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6447 - DNA, 1549 bp, Pantoea wallisii
  ref <308>: DATABASE ACCESSION NUMBER: NCBI ACCESSION: NZ_MLFS01000124.1
  ref <309>: DATABASE ENTRY DATE: 2019-04-01
  ref <313>: RELEVANT RESIDUES IN SEQ ID NO: (1)..(1549)
aaattgaagagtttgatcatggctcagattgaacgctggcggcaggcctaacacatgcaagtcggacggtagcacagaagagcttgctcttcgggtgacgagtggcggacgggtgagtaatgtctgggaaactgcccgatggcgggggataactactggaaacggtagctaataccgcataacgtcgcaagaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtaaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgggtagtgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 6448 - DNA, 1527 bp, Papillibacter cinnamivorans
  ref <308>: DATABASE ACCESSION NUMBER: NCBI ACCESSION: NZ_FWXW01000003.1
  ref <309>: DATABASE ENTRY DATE: 2019-04-01
  ref <313>: RELEVANT RESIDUES IN SEQ ID NO: (1)..(1527)
ttattgagagtttgatcctggctcaggacgaacgctggcggcgtgcctaacacatgcaagtcgaacgaaaataccaaagcagcaatgcgggggtattttagtggcggacgggtgagtaacgcgtgagcaatctgccttttggagggggataccgactggaaacggtcgttaataccgcataacgtatatggacgacatcgtccgtataccaaaggagcaatccgccgaaagatgagctcgcgtctgattagctagttggcggggtaaaggcccaccaaggcgacgatcagtagccggactgagaggttgaacggccacattgggactgagatacggcccagactcctacgggaggcagcagtggggaatattgggcaatgggcgaaagcctgacccagcaacgccgcgtgaaggaagaaggccttcgggttgtaaacttctttgaccagggaagaagaagtgacggtacctggaaaacaagccacggctaactacgtgccagcagccgcggtaatacgtaggtggcaagcgttgtccggatttactgggtgtaaagggcgtgtaggcgggattgcaagtcagatgtgaaatgccggggcttaaccccggagctgcatttgaaactgtagttcttgagtgatggagaggcaggcggaattcctagtgtagcggtgaaatgcgtagatattaggaggaacaccagtggcgaaggcggcctgctggacattaactgacgctgaggcgcgaaagcgtggggagcaaacaggattagataccctggtagtccacgctgtaaacgatggatactaggtgtgggaggtctgaccccttccgtgccggagttaacacaataagtatcccacctggggagtacgatcgcaaggttgaaactcaaaggaattgacgggggcccgcacaagcagtggagtatgtggtttaattcgaagcaacgcgaagaaccttaccaggatttgacatcctactaacgaggtagagatacgtcaggtgcccttcggggaaagtagagacaggtggtgcatggttgtcgtcagctcgtgtcgtgagatgttgggttaagtcccgcaacgagcgcaacccttattgctagttgctacgcaagagcactctagcgagactgccgttgacaaaacggaggaaggcggggacgacgtcaaatcatcatgccccttatgtcctgggctacacacgtactacaatggcggttaacagagggaagcaagacagtgatgtggagcaaatccctaaaaaccgtctcagttcggatcgcaggctgcaacccgcctgcgtgaagtcggaattgctagtaatcgcggatcagcatgccgcggtgaatacgttcccgggccttgtacacaccgcccgtcacaccatgagagtcgggaatacccgaagtccgtagtctaaccgcaagggggacgcggccgaaggtaggttcgataattggggtgaagtcgtaacaaggtagccgtatcggaaggtgcggctggatcacctcctttctaagga

SEQ ID NO: 6449 - DNA, 1540 bp, Parabacteroides goldsteinii
  ref <308>: DATABASE ACCESSION NUMBER: NCBI ACCESSION: NZ_UYXO01000064.1
  ref <309>: DATABASE ENTRY DATE: 2019-04-01
  ref <313>: RELEVANT RESIDUES IN SEQ ID NO: (1)..(1540)
caatttaaacaacgaagagtttgatcctggctcaggatgaacgctagcgacaggcttaacacatgcaagtcgaggggcagcacgatgtagcaatacattggtggcgaccggcgcacgggtgagtaacgcgtatgcaacctacctatcagaggggaataacccggcgaaagtcggactaataccgcataaaacaggggttccacatggaaatatttgttaaagaattatcgctgatagatgggcatgcgttccattagatagttggtgaggtaacggctcaccaagtccacgatggataggggttctgagaggaaggtcccccacactggtactgagacacggaccagactcctacgggaggcagcagtgaggaatattggtcaatgggcgagagcctgaaccagccaagtcgcgtgaaggatgaaggatctatggtttgtaaacttcttttatatgggaataaagtgaggaacgtgttcctttttgtatgtaccatatgaataagcatcggctaactccgtgccagcagccgcggtaatacggaggatgcgagcgttatccggatttattgggtttaaagggtgcgtaggtggttaattaagtcagcggtgaaagtttgtggctcaaccataaaattgccgttgaaactggttgacttgagtatatttgaggtaggcggaatgcgtggtgtagcggtgaaatgcatagatatcacgcagaactccgattgcgaaggcagcttactaaactataactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcatattgacagctctggaaacagagtctctagtaatagcaatttgcgaggtgctgcatggttgtcgtcagctcgtgccgtgaggtgtcggcttaagtgccataacgagcgcaacccttatcactagttactaacaggtcatgctgaggactctagtgagactgccagcgtaagctgtgaggaaggtggggatgacgtcaaatcagcacggcccttacatccggggcgacacacgtgttacaatggtggggacaaagggcagctaccgtgtgagcggatgcaaatctccaaaccccatctcagttcggatcgaagtctgcaacccgacttcgtgaagctggattcgctagtaatcgcgcatcagccatggcgcggtgaatacgttcccgggccttgtacacaccgcccgtcaagccatgggagttgggggtacctaaagtccgtaaccgcaaggatcggcctagggtaaaaccgatgactggggctaagtcgtaacaaggtagccgtaccggaaggtgcggctggaacacctcctttctgga

SEQ ID NO: 6450 - DNA, 1542 bp, Parabacteroides johnsonii
  ref <308>: DATABASE ACCESSION NUMBER: NCBI ACCESSION: NZ_UYXL01000001.1
  ref <309>: DATABASE ENTRY DATE: 2019-04-01
  ref <313>: RELEVANT RESIDUES IN SEQ ID NO: (1)..(1542)
caatttcaacaacgaagagtttgatcctggctcaggatgaacgctagcgacaggcttaacacatgcaagtcgaggggcatcatggtaagtagcaatacttattgatggcgaccggcgcacgggtgagtaacgcgtatgcaacttacctatcagagggggatagcccggcgaaagtcggattaatactccataaaacaggggttccgcatgggactatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggatgaaggatctatggtttgtaaacttcttttataggggaataaagtgtgggacgtgttccattttgtatgtaccctatgaataagcatcggctaactccgtgccagcagccgcggtaatacggaggatgcgagcgttatccggatttattgggtttaaagggtgcgtaggtggtaatttaagtcagcggtgaaagtttgtggctcaaccataaaattgccgttgaaactgggttacttgagtgtgtttgaggtaggcggaatgcgtggtgtagcggtgaaatgcatagatatcacgcagaactccaattgcgaaggcagcttactaaaccataactgacactgaagcacgaaagcgtgggtatcaaacaggattagataccctggtagtccacgcagtaaacgatgattactaggagtttgcgatacacagtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagtcagaccgaccttgaaagaggttttctagcaatagctgattacgaggtgctgcatggttgtcgtcagctcgtgccgtgaggtgtcggcttaagtgccataacgagcgcaacccttatcactagttactaacaggttaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctctaaaccatgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcaaggatcggcctagggtaaaactggtgactggggctaagtcgtaacaaggtagccgtaccggaaggtgcggctggaacacctcctttctg

SEQ ID NO: 6451 - DNA, 1539 bp, Paraburkholderia aromaticivorans
  ref <308>: DATABASE ACCESSION NUMBER: NCBI ACCESSION: NZ_CP022989.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctgcggatgaaagcgggggatccttcgggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacctcttggttaatacccgagggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6452 - DNA, 1539 bp, Paraburkholderia bannensis
  ref <308>: DATABASE ACCESSION NUMBER: NCBI ACCESSION: NZ_RQIY01000075.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacgtgtcctgtagtgggggatagcccggcgaaagccggattaataccgcatacgatctacggatgaaagcgggggatcttcggacctcgcgctataggggcggccgatggcggattagctagttggtgaggtaaaggctcaccaaggcgacgatccgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccctggtcctaatatggccgggggatgacggtaccggaagaataagcaccggctaactacgtgccagcagccgcggtaatacgtagggtgcaagcgttaatcggaattactgggcgtaaagcgtgcgcaggcggtgatgtaagaccgatgtgaaatccccgggctcaacctgggaactgcattggtgactgcatcgcttgagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactggttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaattccgctgagaggtggaagtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttccag

SEQ ID NO: 6453 - DNA, 1537 bp, Paraburkholderia bryophila
  ref <308>: DATABASE ACCESSION NUMBER: NCBI ACCESSION: NZ_QLTK01000063.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctacggaggaaagggggggatcttaggacctcccgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacttctgccctaatacggcgggaggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgtatcggaaggtgcggctggatcacctcctttccag

SEQ ID NO: 6454 - DNA, 1537 bp, Paraburkholderia caffeinilytica
  ref <308>: DATABASE ACCESSION NUMBER: NCBI ACCESSION: NZ_CP031466.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacggacttcggtctggtggcgagtggcgaacgggtgagtaatacatcggaacgtgtcctgtagtgggggatagcccggcgaaagccggattaataccgcatacgctctacggaggaaagggggggatcttaggacctcccgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacctccgccctaatatggtggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgggtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6455 - DNA, 1541 bp, Paraburkholderia caledonica
  ref <308>: DATABASE ACCESSION NUMBER: NCBI ACCESSION: NZ_CP024905.1
  ref <309>: DATABASE ENTRY DATE: 2019-04-01
  ref <313>: RELEVANT RESIDUES IN SEQ ID NO: (1)..(1541)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctgcggaggaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaacctgcgaaggagggcgcttaccacggtgggattcatgactggggtgaagtcgtaacaaggtagccgtatcggaaggtgcggctggatcacctcctttctcg

SEQ ID NO: 6456 - DNA, 1537 bp, Paraburkholderia caribensis
  ref <308>: DATABASE ACCESSION NUMBER: NCBI ACCESSION: NZ_PYUB01000193.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcggacggcagcgcgggggcaaccctggcggcgagtggcgaacgggtgagtaatacatcggaacgtgtcctggagtgggggatagcccggcgaaagccggattaataccgcatacgctctgtggaggaaagcgggggatcttcggacctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccgcttctctaatacaggggcgggatgacggtaccggaagaataagcaccggctaactacgtgccagcagccgcggtaatacgtagggtgcaagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccttgctgagaggtgagggtgcccgaaagggagccgtaacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6457 - DNA, 1539 bp, Paraburkholderia eburnea
  ref <308>: DATABASE ACCESSION NUMBER: NCBI ACCESSION: NZ_PVUA01000045.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtccagtagtgggggatagcccggcgaaagccggattaataccgcatacgctctatggaggaaagcgggggatcgaaagacctcgcgctataggggtggccgatggcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatccctggtcctaatatggccgggggatgacggtaccggaagaataagcaccggctaactacgtgccagcagccgcggtaatacgtagggtgcaagcgttaatcggaattactgggcgtaaagcgtgcgcaggcggtgatgcaagaccgatgtgaaatccccgggctcaacctgggaactgcattggtgactgcatcgctagagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactggttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggatggaagtctgctgagaggcggatgtgcccgaaagggagccatcacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttctcg

SEQ ID NO: 6458 - DNA, 1537 bp, Paraburkholderia ginsengiterrae
  ref <308>: DATABASE ACCESSION NUMBER: NCBI ACCESSION: NZ_LXJZ01000218.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctggagtgggggatagcccggcgaaagccggattaataccgcatacgctctgaggaggaaagggggggatcgcaagacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcggggttaatacccctggaggatgacggtaccggaagaataagcaccggctaactacgtgccagcagccgcggtaatacgtagggtgcgagcgttaatcggaattactgggcgtaaagcgtgcgcaggcggtccgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6459 - DNA, 1539 bp, Paraburkholderia graminis
  ref <308>: DATABASE ACCESSION NUMBER: NCBI ACCESSION: NZ_CP024934.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctgcggaggaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaaccgcctggctaatatccgggcgggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaagtccgctgagaggtggatgtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6460 - DNA, 1537 bp, Paraburkholderia insulsa
  ref <308>: DATABASE ACCESSION NUMBER: NCBI ACCESSION: NZ_PVZM01000067.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctacggaggaaagggggggatcttaggacctcccgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacgccgtggttaatacccgtggcggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6461 - DNA, 1532 bp, Paraburkholderia kirstenboschensis
  ref <308>: DATABASE ACCESSION NUMBER: NCBI ACCESSION: NZ_JRZC01000915.1
  ref <309>: DATABASE ENTRY DATE: 2019-04-01
  ref <313>: RELEVANT RESIDUES IN SEQ ID NO: (1)..(1532)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctacggaggaaaggggatcttaggacctctcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacttctgggttaataccctgggaggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 6462 - DNA, 1537 bp, Paraburkholderia kururiensis
  ref <308>: DATABASE ACCESSION NUMBER: NCBI ACCESSION: NZ_RJZE01000064.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcggacggcagcgcgggcttcggcctggcggcgagtggcgaacgggtgagtaatacatcggaacgtatcctggagtgggggatagcccggcgaaagccggattaataccgcatacgctctgaggaggaaagcgggggaccttcgggcctcgcgctcaaggggcggccgatggcggattaggtagttggtggggtaaaggcctaccaagccgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcatcggggccaatacccctggtggatgacggtaccggaagaataagcaccggctaactacgtgccagcagccgcggtaatacgtagggtgcgagcgttaatcggaattactgggcgtaaagcgtgcgcaggcggtgctgtaagaccgatgtgaaatccccgggcttaacctgggaactgcattggtgactgcagcgctggagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactggttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccctggtgagagccgggggtgcccgaaagggagccgtaacacaggtgctgcatggctgtcgtcagctcgtgtcgtgagatgttgggttaagtcccgcaacgagcgcaacccttgtccccagttgctacgcaagagcactccggggagactgccggtgacaaaccggaggaaggtggggatgacgtcaagtcctcatggcccttatgggtagggcttcacacgtcatacaatggtcggaacagagggttgcgaagccgcgaggtggagccaatcccagaaaaccgatcgtagtccggattgcagtctgcaactcgactgcatgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttccag

SEQ ID NO: 6463 - DNA, 1536 bp, Paraburkholderia phenoliruptrix
  ref <308>: DATABASE ACCESSION NUMBER: NCBI ACCESSION: NC_018695.1
  ref <309>: DATABASE ENTRY DATE: 2019-04-01
  ref <313>: RELEVANT RESIDUES IN SEQ ID NO: (1)..(1536)
ttgaactgaagagtttgatcctggctcagattgaacgctggcggcatgccttacacatgcaagtcggacggcagcgcgggcttcggcctggcggcgagtggcgaacgggtgagtaatacatcggaacgtgtcctgtagtgggggatagcccggcgaaagccggattaataccgcatacgctctgcggaggaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacgtcgtggctaatacccgtggcggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggatggaatcccgctgagaggtgggagtgcccgaaagggagccatcacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttc

SEQ ID NO: 6464 - DNA, 1538 bp, Paraburkholderia phosphatilytica
  ref <308>: DATABASE ACCESSION NUMBER: NCBI ACCESSION: NZ_QQOA01000087.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcggacggcagcgcgggagcaatcctggcggcgagtggcgaacgggtgagtaatacatcggaacgtgtcctggagtgggggatagcccggcgaaagccggattaataccgcatacgctctatggaggaaagcgggggaccttcgggcctcgcgctcaaggggcggccgatggcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcatcctgtcgaataaacggggtggatgacggtaccggaagaataagcaccggctaactacgtgccagcagccgcggtaatacgtagggtgcgagcgttaatcggaattactgggcgtaaagcgtgcgcaggcggtgatgtaagaccgatgtgaaatccccgggcttaacctgggaactgcattggtgactgcatcgctggagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccctgccgagaggtgggggtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6465 - DNA, 1539 bp, Paraburkholderia rhynchosiae
  ref <308>: DATABASE ACCESSION NUMBER: NCBI ACCESSION: NZ_PNXY01000081.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctgcggaggaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcggggctaatacctctgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaacctggctgagaggccggggtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6466 - DNA, 1535 bp, Paraburkholderia silvatlantica
  ref <308>: DATABASE ACCESSION NUMBER: NCBI ACCESSION: NZ_QJSQ01000064.1
  ref <309>: DATABASE ENTRY DATE: 2019-04-01
  ref <313>: RELEVANT RESIDUES IN SEQ ID NO: (1)..(1535)
attgaactgaagagtttgatcctggctcagattgaacgctggcggcatgccttacacatgcaagtcggacggcagcgcgggcttcggcctggcggcgagtggcgaacgggtgagtaatacatcggaacatgtccagtagtgggggatagcccggcgaaagccggattaataccgcatacgctctgcggaggaaagcgggggatcgaaagacctcgcgctattggggtggccgatggcggattagctagatggtggggtaaaggcctaccatggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatccttttcgataataccggaaggggatgacggtaccggaagaataagcaccggctaactacgtgccagcagccgcggtaatacgtagggtgcgagcgttaatcggaattactgggcgtaaagcgtgcgcaggcggtgatgtaagaccgatgtgaaatccccgggcttaacctgggaactgcattggtgactgcatcgctggagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactggttgtcgggccttcactggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggacggaagaccggtgagagctggttgtgcccgaaagggagccgtcacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtagccaagccgcgaggtggagccaatcccggaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttc

SEQ ID NO: 6467 - DNA, 1537 bp, Paraburkholderia sp. 7MK8-2
  ref <308>: DATABASE ACCESSION NUMBER: NCBI ACCESSION: NZ_RBZV01000029.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcgcgggcttcggcctggcggcgagtggcgaacgggtgagtaatacatcggaacgtgtcctggagtgggggatagcccggcgaaagccggattaataccgcatacgctctacggaggaaagcgggggatcttcggacctcgcgctcaaggggcggccgatggcggattagctagttggtggggtaaaggcctaccaaggcgacgatccgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaatccttgaccctaatatggtcgggggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggacggaatcccgctgagaggtgggggtgctcgaaagagaaccgtcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6468 - DNA, 1539 bp, Paraburkholderia sp. BL17N1
  ref <308>: DATABASE ACCESSION NUMBER: NCBI ACCESSION: NZ_RBIW01000002.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctgtggatgaaagcgggggatccttcgggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctccgccctaatacggtggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6469 - DNA, 1539 bp, Paraburkholderia sp. BL18I3N2
  ref <308>: DATABASE ACCESSION NUMBER: NCBI ACCESSION: NZ_PVNC01000051.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctgcggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgggttaataccctggggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6470 - DNA, 1537 bp, Paraburkholderia sp. BL21I4N1
  ref <308>: DATABASE ACCESSION NUMBER: NCBI ACCESSION: NZ_PVEN01000043.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctacggaggaaagggggggatcttaggacctcccgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggtcttcattgacttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctag

SEQ ID NO: 6471 - DNA, 1537 bp, Paraburkholderia sp. BL23I1N1
  ref <308>: DATABASE ACCESSION NUMBER: NCBI ACCESSION: NZ_RAPV01000001.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctacggaggaaagggggggatcttaggacctctcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacctccgccctaatacggtggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggtcttcattgacttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6472 - DNA, 1537 bp, Paraburkholderia sp. BL25I1N1
  ref <308>: DATABASE ACCESSION NUMBER: NCBI ACCESSION: NZ_PVZB01000063.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgatctgtggatgaaagcgggggatcttaggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcggccctaatacggtggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6473 - DNA, 1537 bp, Paraburkholderia sp. BL27I4N3
  ref <308>: DATABASE ACCESSION NUMBER: NCBI ACCESSION: NZ_QREJ01000001.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgatctgtggatgaaagcgggggatcttaggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgggttaataccctggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6474 - DNA, 1551 bp, Paraburkholderia sp. BL6669N2
  ref <308>: DATABASE ACCESSION NUMBER: NCBI ACCESSION: NZ_QUNA01000001.1
  ref <309>: DATABASE ENTRY DATE: 2019-04-01
  ref <313>: RELEVANT RESIDUES IN SEQ ID NO: (1)..(1551)
ttgaactgaagagtttgatcctggctcagattgaacgctggcggcatgccttacacatggcaagtcgaacggcagcacgggagcaatcctggtgggcgagtggcgaaacgggtgagtgataacatcggaacgtgtcctgtagttgggggagtagcccggcgaaagccggaatttaataccgcatacatctgtggatgaaagcgggggatcttaggacctcgcgctacagggggcggccgatggcagattagctagttggtggggtaaaggcctaccaaggcgacgatcctgtagctggtctgagaggacgagccagccacactgggactgagacacggcccagactcctacgggaggcagcagtggggaattttggacaatgggcgcaagcctgatccagcaatgccggcgtgtgtgaagaaggccttcgggttgtaaagcacttttgtccggaaagaaaacctctgccctaatacggtggggggatgacggtaccggaagaataagcaccggctaactacgtgccagcagccgcggtaatacgtagggtgcaagcgttaatcggaattactgggcgtaaaagcgtgcgcaggcggtccgctaagacagatgtgaaatccccgggcttaacctgggaaactgcatttgtgactggcgggctagagtatgcagaggggggtagaattccacgtgtagcagtgaaatgcgtagagatgtggaggaataccgatggcgaaggcagccccctgggccaatactgacgctcatgcacgaaagcgtggggagcaaacaggattagatacccctggtagtccacgccctaaacgatgtcaactagttgtcgggtcttcattgacttggtaacgtagctaacgcgtgaagttgaccgcctggggagtacggtcgcaagattaaaaactcaaaaggaattgacggggacccgcacagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6475 - DNA, 1537 bp, Paraburkholderia sp. C35
  ref <308>: DATABASE ACCESSION NUMBER: NCBI ACCESSION: NZ_QBUY01000208.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctcgagagaggaaagcgggggatcttcggacctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgtccctaatatggatggaggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccttgctgagaggtgagggtgcccgaaagggagccgtaacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6476 - DNA, 1540 bp, Paraburkholderia sp. DCR13
  ref <308>: DATABASE ACCESSION NUMBER: NCBI ACCESSION: NZ_CP029640.1
  ref <309>: DATABASE ENTRY DATE: 2019-04-01
  ref <313>: RELEVANT RESIDUES IN SEQ ID NO: (1)..(1540)
attgaactgaagagtttgatcctggctcagattgaacgctggcggcatgccttacacatgcaagtcgaacggcagcacgggtgcttgcacctggtggcgagtggcgaacgggtgagtaatacatcggaacatgtccagtagtgggggatagcccggcgaaagccggattaataccgcatacgctctacggaggaaagcgggggatcgcaagacctcgcgctattggggtggccgatggcagattaggtagttggtggggtaaaggcctaccaagccgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctctgggttaataccccggggggatgacggtaccggaagaataagcaccggctaactacgtgccagcagccgcggtaatacgtagggtgcaagcgttaatcggaattactgggcgtaaagcgtgcgcaggcggtgatgcaagaccgatgtgaaatccccgggcttaacctgggaactgcattggtgactgcatcgctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaagtctgccgagaggtggatgtgcccgaaagggagccgtaacacaggtgctgcatggctgtcgtcagctcgtgtcgtgagatgttgggttaagtcccgcaacgagcgcaacccttgtccccagttgctacgcaagagcactccggggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttccag

SEQ ID NO: 6477 - DNA, 1003 bp, Paraburkholderia sp. DHOA04
  ref <308>: DATABASE ACCESSION NUMBER: NCBI ACCESSION: NZ_RQIS01000057.1
  ref <309>: DATABASE ENTRY DATE: 2019-04-01
  ref <313>: RELEVANT RESIDUES IN SEQ ID NO: (1)..(1003)
attgaactgaagagtttgatcctggctcagattgaacgctggcggcatgccttacacatgcaagtcgaacggcagcacggacttcggtctggtggcgagtggcgaacgggtgagtaatacatcggaacatgtccagtagtgggggatagcccggcgaaagccggattaataccgcatacgatctatggatgaaagcgggggatcgcaagacctcgcgctattggggtggccgatggcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccgggaagaaatcctcttcgataataccgaggggggatgacggtaccggaagaataagcaccggctaactacgtgccagcagccgcggtaatacgtagggtgcaagcgttaatcggaattactgggcgtaaagcgtgcgcaggcggttttgtaagaccgatgtgaaatccccgggctcaacctgggaactgcattggtgactgcaaggctcgagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaacc

SEQ ID NO: 6478 - DNA, 1538 bp, Paraburkholderia sp. DHOC27
  ref <308>: DATABASE ACCESSION NUMBER: NCBI ACCESSION: NZ_QVQV01000020.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctctgtggaggaaagggggggatcttcggacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaaccatctggctaatatccgggtgggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccgatacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6479 - DNA, 1539 bp, Paraburkholderia sp. GV052; identical to SEQ ID NO: 6459
  ref <308>: DATABASE ACCESSION NUMBER: NCBI ACCESSION: NZ_QKMC01000037.1
  ref <309>: DATABASE ENTRY DATE: 2019-04-01
  ref <313>: RELEVANT RESIDUES IN SEQ ID NO: (1)..(1539)

SEQ ID NO: 6480 - DNA, 1539 bp, Paraburkholderia sp. GV068; identical to SEQ ID NO: 6459
  ref <308>: DATABASE ACCESSION NUMBER: NCBI ACCESSION: NZ_QBUB01000037.1
  ref <309>: DATABASE ENTRY DATE: 2019-04-01
  ref <313>: RELEVANT RESIDUES IN SEQ ID NO: (1)..(1539)

SEQ ID NO: 6481 - DNA, 1539 bp, Paraburkholderia sp. GV072; identical to SEQ ID NO: 6459
  ref <308>: DATABASE ACCESSION NUMBER: NCBI ACCESSION: NZ_QAOP01000039.1
  ref <309>: DATABASE ENTRY DATE: 2019-04-01
  ref <313>: RELEVANT RESIDUES IN SEQ ID NO: (1)..(1539)

SEQ ID NO: 6482 - DNA, 1538 bp, Paraburkholderia sp. NEAU-SY24
  ref <308>: DATABASE ACCESSION NUMBER: NCBI ACCESSION: NZ_QUBS01000043.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctagagtgggggatagcccggcgaaagccggattaataccgcatacgctcgagagaggaaagcgggggatcttcggacctcgcgctcaaggggcggccgatggcggattagctagttggtagggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcctctgggttaatacctcggggggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggcttaacctgggaactgcattggtgactggcgagctagagtgtggcagaggggggtagaattccacgtgtagcagtgaaatgcgtagagatgtggaggaataccgatggcgaaggcagccccctgggctaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggacggaaagctgctgagaggtggccgtgctcgaaagagaaccgtcgcacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6483 - DNA, 1541 bp, Paraburkholderia sp. OV446
  ref <308>: DATABASE ACCESSION NUMBER: NCBI ACCESSION: NZ_QICR01000039.1
  ref <309>: DATABASE ENTRY DATE: 2019-04-01
  ref <313>: RELEVANT RESIDUES IN SEQ ID NO: (1)..(1541)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctgcggaggaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaacctgcaaaggagggcgcttaccacggtgggattcatgactggggtgaagtcgtaacaaggtagccgtatcggaaggtgcggctggatcacctcctttctcg

SEQ ID NO: 6484 - DNA, 1540 bp, Paraburkholderia sp. OV555
  ref <308>: DATABASE ACCESSION NUMBER: NCBI ACCESSION: NZ_QEOE01000046.1
  ref <309>: DATABASE ENTRY DATE: 2019-04-01
  ref <313>: RELEVANT RESIDUES IN SEQ ID NO: (1)..(1540)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctctaaggaggaaagggggggatctttcgggacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaactttcgccctaatacggtgggaggatgacggtaccggaagaataagcaccggctaactacgtgccagcagccgcggtaatacgtagggtgcgagcgttaatcggaattactgggcgtaaagcgtgcgcaggcggtctgttaagacagatgtgaaatccccgggcttaacctgggaactgcatttgtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 6485 - DNA, 1538 bp, Paraburkholderia sp. PDC91
  ref <308>: DATABASE ACCESSION NUMBER: NCBI ACCESSION: NZ_QKTZ01000042.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcgcgggggtaaccctggcggcgagtggcgaacgggtgagtaatacatcggaacgtgtcccgtagtgggggatagcccggcgaaagccggattaataccgcatacgatctacggatgaaagcgggggatcgcaagacctcgcgctatgggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcactctcaccaatactgggggtggatgacggtaccggaagaataagcaccggctaactacgtgccagcagccgcggtaatacgtagggtgcgagcgttaatcggaattactgggcgtaaagcgtgcgcaggcggtgatgtaagaccgatgtgaaatccccgggctcaacctgggaactgcattggtgactgcattgctcgagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactggttgtcgggccttcattggcttggtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccttggtgagagctgagggtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttccag

SEQ ID NO: 6486 - DNA, 1539 bp, Paraburkholderia sp. RAU2J
  ref <308>: DATABASE ACCESSION NUMBER: NCBI ACCESSION: NZ_RBXG01000001.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcggacggcagcacggacttcggtctggtggcgagtggcgaacgggtgagtaatacatcggaacgtgtcctggagtgggggatagcccggcgaaagccggattaataccgcatacgctctgaggaggaaagcgggggatctttcgggacctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcccttgggcgaataccctggggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggccggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggcggagccaatcccagaaaaccgatcgtagtccggatcgcactctgcaactcgggtgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 6487 - DNA, 1537 bp, Paraburkholderia sp. S27
  ref <308>: DATABASE ACCESSION NUMBER: NCBI ACCESSION: NZ_QHKS01000019.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgctctacggaggaaagggggggatcttcggacctcccgctacaggggcggccgatggcagattagctggttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacctcggggctaatacctctgggggatgacggtaccggaagaataagcaccggctaactacgtgccagcagccgcggtaatacgtagggtgcaagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactggttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggccggggtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6488 - DNA, 1537 bp, Paraburkholderia sp. UYCPa14C
  ref <308>: DATABASE ACCESSION NUMBER: NCBI ACCESSION: NZ_SELS01000157.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctctgaggaggaaagcgggggatcttcggacctcgcgctcaaggggcggccgatggcagattaggtagttggtggggtaaaggcctaccaagccgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgggttaataccccggtgggatgacggtaccggaagaataagcaccggctaactacgtgccagcagccgcggtaatacgtagggtgcgagcgttaatcggaattactgggcgtaaagcgtgcgcaggcggtgatgtaagaccgatgtgaaatccccgggcttaacctgggaactgcattggtgactgcatcgctcgagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactggttgtcgggccttcattggcttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgccgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 6489 - DNA, 1534 bp, Paraburkholderia terrae
  ref <308>: DATABASE ACCESSION NUMBER: NCBI ACCESSION: NZ_CP026111.1
  ref <309>: DATABASE ENTRY DATE: 2019-04-01
  ref <313>: RELEVANT RESIDUES IN SEQ ID NO: (1)..(1534)
ttgaactgaagagtttgatcctggctcagattgaacgctggcggcatgccttacacatgcaagtcgaacggcagcgcgggggcaaccctggcggcgagtggcgaacgggtgagtaatacatcggaacgtgtcctggagtgggggatagcccggcgaaagccggattaataccgcatacgatcctgggatgaaagcgggggaccgaaaggcctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacctccgtcctaatacggtggggggatgacggtaccggaagaataagcaccggctaactacgtgccagcagccgcggtaatacgtagggtgcaagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccttgctgagaggtgagggtgcccgaaagggagccgtaacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttc

SEQ ID NO: 6490 - DNA, 1537 bp, Paraburkholderia unamae
  ref <308>: DATABASE ACCESSION NUMBER: NCBI ACCESSION: NZ_QLSU01000073.1
  ref <309>: DATABASE ENTRY DATE: 2019-04-01
  ref <313>: RELEVANT RESIDUES IN SEQ ID NO: (1)..(1537)
attaaactgaagagtttgatcctggctcagattgaacgctggcggcatgccttacacatgcaagtcgaacggcagcacgggtgcttgcacctggtggcgagtggcgaacgggtgagtaatacatcggaacatgtccagtagtgggggatagcccggcgaaagccggattaataccgcatacgatctttggatgaaagcgggggaccttcgggcctcgcgctattggggtggccgatggcggattagctagttggtggggtaaaggctcaccaaggcgacgatccgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctttgggctaataccctagggggatgacggtaccggaagaataagcaccggctaactacgtgccagcagccgcggtaatacgtagggtgcaagcgttaatcggaattactgggcgtaaagcgtgcgcaggcggtgatgcaagaccgatgtgaaatccccgggctcaacctgggaactgcattggtgactgcatcgctagagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactggttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaagtccgctgagaggtggatgtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtggctagtctaaccgcaaggaggacggtcaccacggcaggattcatgactggggtgaagtcgtaacaaggtagccgtatcggaaggtgcggctggatcacctcctttc

SEQ ID NO: 6491 - DNA, 1534 bp, Paraburkholderia xenovorans
  ref <308>: DATABASE ACCESSION NUMBER: NCBI ACCESSION: NZ_CP008760.1
  ref <309>: DATABASE ENTRY DATE: 2019-04-01
  ref <313>: RELEVANT RESIDUES IN SEQ ID NO: (1)..(1534)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctgcggaggaaagcgggggatcttcggacctcgcgctacaggggcggccgatggcagattagctggttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgccctaatacggtggggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaagtctgctgagaggtggatgtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgggtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttc

SEQ ID NO: 6492 - DNA, 1547 bp, Parachlamydia acanthamoebae
  ref <308>: DATABASE ACCESSION NUMBER: NCBI ACCESSION: NZ_BAWW01000035.1
  ref <309>: DATABASE ENTRY DATE: 2019-04-01
  ref <313>: RELEVANT RESIDUES IN SEQ ID NO: (1)..(1547)
tttaacttgagaatttgatcttggttcagattgaatgctgacggcgtggatgaggcatgcaagtcgaacgaaacgggcaaccgtttagtggcggaagggttagtaatacatggataacttgcctttaactttgggataacgattggaaacgatcgctaataccaaatgtggtggggtaattaatttacctttatcaaagtgggggatcgcaagacctcgcggttaaagagaggtccatgggatatcagctagttggtgtggtaatggcgcaccaaggctaagacgtctaggcggattgagagattgaccgccaacactgggactgagaactgcccagactcctacgggaggctgcagtcgagaatcattcgcaatgggcgaaagcctgacgatgcgacgccgtgtgagcgatgaaggccttagggtcgtaaagctctttcgcctgggagcaagagaagccgactaatattcggctaatttgagagtaccaggtaaagaagcaccggctaactccgtgccagcagctgcggtaatacggagggtgcaagcattaatcggatttattgggcgtaaagggcgcgtaggcgggaacataagtcagatgtgaaatcctggagctcaactccagaacagcatttgaaactatatttcttgagggtaggcggagaaaacggaattccacatgtagcggtgaaatgcgtagatatgtggaagaacatcggtggcgaaggcggttttctagcttattcctgacgctgaggcgcgaaagcaaggggagcaaacaggattagataccctggtagtccttgccgtaaacgatgtatacttggtgtaattggactcaaccccaattgtgccggagctaacgcgttaagtataccgcctggggagtacgctcgcaagggtgaaactcaaaagaattgacggggacccgcacaagcagtggagcatgtggtttaattcgatgcaacgcgaagaaccttacccagacttgacatgcagaagacagctttagagatagagtgttccttagggacttctgcacaggtgctgcatggctgtcgtcagctcgtgccgtgaggtgttgggttaagtcccgcaacgagcgcaacccttatcattagttgccaacacgtaatggtgggaactctaatgagactgcctgggttaaccaggaggaaggtgaggatgacgtcaagtccgcatggcccttatgtctggggctacacacgtgctacaatggtcggtacagaaggcagcgaagccgtgaggtgaagcaaatcccaaaaagccgatcccagttcagattgtagtctgcaactcgactacatgaagatggaattgctagtaatggcgagtcagcaacatcgccgtgaatacgttcccgggtcttgtacacaccgcccgtcacatcatgggagttggttttacccgaagccgctgacttaaccgcaaggagagaagcgtcgaaggtgaggctgatgactgggatgaagtcgtaacaaggtagccctatcggaaggtggggctggatcacctcctttaaa

SEQ ID NO: 6493 - DNA, 1554 bp, Parachlamydia sp. C2
  ref <308>: DATABASE ACCESSION NUMBER: NCBI ACCESSION: NZ_FCNU01000016.1
  ref <309>: DATABASE ENTRY DATE: 2019-04-01
  ref <313>: RELEVANT RESIDUES IN SEQ ID NO: (1)..(1554)
ttttctgtgagaatttgatcttggttcagattgaatgctgacggcgtggatgaggcatgcaagtcgaacgaaaccttcgggtttagtggcggaagggttagtaatacatgggtaacctgcctttaactctgggataacgattggaaacgatcgctaatactggatatggtggatttaagacatcttaaatctattaaagtgggggatcttcggacctcgcggttaaagaggggcccatgggatatcagctagtaggtagggtaatggcctacctaggctaagacgtctaggcggattgagagattgaccgccaacactgggactgagaactgcccagactcctacgggaggctgcagtcgagaatcattcgcaatgggcgaaagcctgacgatgcgacgccgtgtgagcgaagaaggccttagggtcgtaaagctctttcgcttgggaacaaggagatccggctaatatccggagaacttgagcgtaccaggtaaagaagcaccggctaactccgtgccagcagctgcggtaatacggagggtgcaagcattaatcggatttattgggcgtaaagggcgcgtaggcggggatataagtcagacgtgaaatcccggggctcaacctcggaacagcatttgaaactatatctcttgagggtaggcggagaaaacggaattccacaagtagcggtgaaatgcgtagatatgtggaagaacaccggtggcgaaggcggttttctagcttactcctgacgctaaagcgcgaaagcaaggggatcaaacaggattagataccctggtagtccttgccgtaaactatgtatacttggtgtaaccggactcaaccctggttgtgccgtagctaacgtgttaagtataccgcctggggagtacagtcgcaaggctgaaactcaaaagaattgacggggacccgcacaagcagtggagcatgtggtttaattcgatgcaacgcgaagaaccttacccaggcttgacatgcagtagaccggtccagagatgggcctttccttcgggactgctgcacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacagaaggcagcgaagccgcgaggtggagcaaatcccgaaagccggcctcagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaaggggagaggcgtgtaaggtaaggccgatgactgggatgaagtcgtaacaaggtagccctaccggaaggtggggctggatcacctcctttaaaggacagttt

SEQ ID NO: 6494 - DNA, 1549 bp, Parachlamydiaceae bacterium HS-T3
  ref <308>: DATABASE ACCESSION NUMBER: NCBI ACCESSION: NZ_BBPT01000010.1
  ref <309>: DATABASE ENTRY DATE: 2019-04-01
  ref <313>: RELEVANT RESIDUES IN SEQ ID NO: (1)..(1549)
ttttattgagaatttgatcttggttcagattgaatgctgacagcgtggatgaggcatgcaagtcgaacggaatacggggcaactcgtatttagtggcggaagggttagtaatacatgggtaacctgcctttaactttgggataacgattggaaacgatcgctaataccaaatgtggtgcaagaagtatcttcttgttattaaagtgggggatcgcaagacctcgcggttaaagaggggcccatgggatatcagctagttggtgaggtaacggctcaccaaggctaagacgtctaggcggattgagagattgaccgccaacactgggactgagaactgcccagactcctacgggaggctgcagtcgagaatcattcgcaatgggcgaaagcctgacgatgcgacgctgtgtgagcgatgaaggccttcgggtcgtaaagctctttcgcctgggaacaagaaaggcaagttaataccttgccaatttgagggtaccaggtaaagaagcaccggctaactccgtgccagcagctgcggtaatacggagggtgcaagcattaatcggatttattgggcgtaaagggcgcgtaggcggaagaataagtcgggcgtgaaatcccagggctcaaccctggaacagcgcttgaaactatttttcttgagggtaggcggagaaaacggaattccacaagtagcggtgaaatgcgtagatatgtggaagaacacccgtggcgaaggcggttttctagcttatacctgacgctgaggcgcgaaagcaaggggatcaaacaggattagataccctggtagtccttgccgtaaactatgtatacttggtgtaactggactcaaccctagttgtgccgaagctaacgcgataagtataccgcctgaggagtacgctcgcaagggtgaaactcaaaagaattgacggggacccgcacaagcagtggagcatgtggtttaattcgatgcaacgcgaagaaccttacccaggcttgacatgcaaaggacagcactagagatagtgcctcccttcggggcctttgcacaggtgctgcatggctgtcgtcagctcgtgccgtgaggtgttgggttaagtcccgcaacgagcgcaacccttatcattagttgccaacacttagggtgggaactctaatgagactgcctgggttaaccaggaggaaggtgaggatgacgtcaagtccgcatggcccttatgtctggggctacacacgtgctacaatggtcggtacagaaggcagcgaaaccgcgaggtgaagcaaatccaaaaaaccgatctcagttcagattgtagtctgcaactcgactacatgaagacggaattgctagtaatggcgagtcagcaacatcgccgtgaatacgttcccgggtcttgtacacaccgcccgtcacatcatgggagttggttttacccgaagccgctgacttaaccgcaaggagagaagcgtctaaggtaaggctgatgactgggatgaagtcgtaacaaggtagcccttccggaaggaggggctggatcacctcctttaa

SEQ ID NO: 6495 - DNA, 1465 bp, Paracoccus aestuarii
  ref <308>: DATABASE ACCESSION NUMBER: NCBI ACCESSION: NZ_QZEV01000160.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcttaacacatgcaagtcgagcgagaccttcgggtctagcggcggacgggtgagtaacgcgtgggaacgtgcccttctctacggaatagccccgggaaactgggagtaataccgtatacgccctttgggggaaagatttatcggagaaggatcggcccgcgttggattaggtagttggtggggtaatggcccaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagttgggggtgaaatcccggggctcaacctcggaactgccttcaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacattacaggaccggtccggagacggatctttcacttcggtgacctgtggacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 6496 - DNA, 1468 bp, Paracoccus aminophilus
  ref <308>: DATABASE ACCESSION NUMBER: NCBI ACCESSION: NC_022041.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgagcgcgcccttcggggtgagcggcggacgggtgagtaacacgtgggaacatacccttttctacggaatagcctcgggaaactgagagtaataccgtatacgcccttcgggggaaagatttatcggagaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagttggaggtgaaatcccagggctcaaccttggaactgccttcaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgtaggacaactccagagatggagctttctcgtaagagacctatagacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatggaggcagcggaccacggtaggctcagcgactggggtgaagtcgtaacaaggtagccgtaggggaacctgcggctggatcacctcctttctaa

SEQ ID NO: 6497 - DNA, 1467 bp, Paracoccus aminovorans
  ref <308>: DATABASE ACCESSION NUMBER: NCBI ACCESSION: NZ_FOPU01000070.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagatcttcggatctagcggcggacgggtgagtaacgcgtgggaacgtgcccttctctacggaatagcctcgggaaactgggagtaataccgtatacgccccttgggggaaagatttatcggagaaggatcggcccgcgttggattaggtagttggtggggtaatggcctaccaagcctacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaacctcggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggacagccggagagattcggtcttctcgtaagagacctgtggacaggtgctgcatggctgtcgtcagctcgtgtcgtgagatgttcggttaagtccggcaacgagcgcaacccacacttccagttgccatcatttggttgggcactctggaagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttggttctacccgacggccgtgcgctaaccagcaatgggggcagcggaccacggtaggatcagcgactggggtgaagtcgtaacaaggtagccgtaggggaacctgcggctggatcacctcctttcta

SEQ ID NO: 6498 - DNA, 1465 bp, Paracoccus bengalensis
  ref <308>: DATABASE ACCESSION NUMBER: NCBI ACCESSION: NZ_QTUJ01000001.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgcaccttcgggtgagcggcggacgggtgagtaacgcgtgggaatatgccctttggtacggaatagtcctgggaaactgggggtaataccgtatgcgcccttcgggggaaagatttatcgccaaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggaccggcccggagacgggtctttcacttcggtgacctggagacaggtgctgcatggctgtcgtcagctcgtgtcgtgagatgttcggttaagtccggcaacgagcgcaacccacacttccagttgccatcatttggttgggcactctggaagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatgggggcagcggaccacggtaggctcagcgactggggtgaagtcgtaacaaggtagccgtaggggaacctgcggctggatcacctcctttctaa

SEQ ID NO: 6499 - DNA, 1463 bp, Paracoccus contaminans
  ref <308>: DATABASE ACCESSION NUMBER: NCBI ACCESSION: NZ_CP020612.1
  ref <309>: DATABASE ENTRY DATE: 2019-04-01
  ref <313>: RELEVANT RESIDUES IN SEQ ID NO: (1)..(1463)
caacttgagagtttgatcctggctcagaacgaacgctggcggcaggcctaacacatgcaagtcgagcgcccgcaagggagcggcggacgggtgagtaacgcgtgggaatatgcccttctctacggaatagcctcgggaaactgagagtaataccgtatacgcccttttggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaacctcggaactgccttcaaaactactggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggacagctccagagatggagtcttcacttcggtgacctggagacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcgtaacagcatgacgcggtgaatacgttcccgggccttgtacacaccgcccgtcacaccatgggagttgggtctacccgacggccgtgcgctaacccttacgggaggcagcggaccacggtaggctcagcgactggggtgaagtcgtaacaaggtagccgtaggggaacctgcggctggatcacctcctttctaa

SEQ ID NO: 6500 - DNA, 1468 bp, Paracoccus denitrificans
  ref <308>: DATABASE ACCESSION NUMBER: NCBI ACCESSION: NZ_FOYK01000070.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgagcgaacccttcggggttagcggcggacgggtgagtaacgcgtgggaatatgccctttgctacggaatagccccgggaaactgggagtaataccgtatacgccctttgggggaaagatttatcggcaaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccggaaagttgggggtgaaatcccggggctcaacctcggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggaccgctccagagatggagttttctcgtaagagacctgtggacaggtgctgcatggctgtcgtcagctcgtgtcgtgagatgttcggttaagtccggcaacgagcgcaacccacactcttagttgccagcatttggttgggcactctaagagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatggaggcagcggaccacggtaggctcagcgactggggtgaagtcgtaacaaggtagccgtaggggaacctgcggctggatcacctcctttctaa

SEQ ID NO: 6501 - DNA, 1463 bp, Paracoccus halophilus
  ref <308>: DATABASE ACCESSION NUMBER: NCBI ACCESSION: NZ_FOJO01000006.1
  ref <309>: DATABASE ENTRY DATE: 2019-04-01
  ref <313>: RELEVANT RESIDUES IN SEQ ID NO: (1)..(1463)
caacttgagagtttgatcctggctcagaacgaacgctggcggcaggcctaacacatgcaagtcgagcgcgccttcgggtgagcggcggacgggtgagtaacacgtgggaatatgcccttctctacggaatagtcctgggaaactgggggtaataccgtatacgcccttttggggaaagatttatcggagaaggattagcccgcgttggattaggtagttggtggggtaatggctcaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaacctcggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgcaccagagatggtgttttcacttcggtgaccgagtgacaggtgctgcatggctgtcgtcagctcgtgtcgtgagatgttcggttaagtccggcaacgagcgcaacccacactttcagttgccatcattcagttgggcactctggaagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgccaaccttttggaggcagcggaccacggtaggctcagcgactggggtgaagtcgtaacaaggtagccgtaggggaacctgcggctggatcacctcctttctaa

SEQ ID NO: 6502 - DNA, 1465 bp, Paracoccus pantotrophus; identical to SEQ ID NO: 6498
  ref <308>: DATABASE ACCESSION NUMBER: NCBI ACCESSION: NZ_FPKI01000098.1
  ref <309>: DATABASE ENTRY DATE: 2019-04-01
  ref <313>: RELEVANT RESIDUES IN SEQ ID NO: (1)..(1465)

SEQ ID NO: 6503 - DNA, 1464 bp, Paracoccus saliphilus
  ref <308>: DATABASE ACCESSION NUMBER: NCBI ACCESSION: NZ_FTOU01000039.1
  ref <309>: DATABASE ENTRY DATE: 2019-04-01
  ref <313>: RELEVANT RESIDUES IN SEQ ID NO: (1)..(1464)
caacttgagagtttgatcctggctcagaacgaacgctggcggcaggcttaacacatgcaagtcgagcgaagacttcggtcttagcggcggacgggtgagtaacgcgtgggaacgtgcccttcactacggaatagcccagggaaacttggattaataccgtatacgcccttcgggggaaagaatttcggtgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggacaggaaagttgggggtgaaatcccggggctcaaccccggaactgcctccaaaactatctgtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgatccggagacggatttttctcgtaagagaccaggagacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatcccaaaaaaccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 6504 - DNA, 1467 bp, Paracoccus sanguinis
  ref <308>: DATABASE ACCESSION NUMBER: NCBI ACCESSION: NZ_FNNA01000013.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgagatcttcgggtctagcggcggacgggtgagtaacgcgtgggaatatgcctcttggtacggaatagcctcgggaaactgggagtaataccgtatgtgccctttgggggaaagatttatcgccaagagattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggacatccccagagatggggctttcacttcggtgaccgagagacaggtgctgcatggctgtcgtcagctcgtgtcgtgagatgttcggttaagtccggcaacgagcgcaacccacactttcagttgccatcattcagttgggcactctggaagaactgccggtgataagccggaggaaggtgtggatgacgtcaagtcctcatggcccttacgggttgggctacacacgtgctacaatggtggtgacagtgggttaatccccaaaagccatctcagttcggattgtcgtctgcaactcgacggcatgaagttggaatcgctagtaatcgcgtaacagcatgacgcggtgaatacgttcccgggccttgtacacaccgcccgtcacaccatgggagttgggtctacccgacggccgtgcgctaacccttacgggaggcaacggaccacggtaggctcagcgactggggtgaagtcgtaacaaggtagccgtaggggaacctgcggctggatcacctcctttctaa

SEQ ID NO: 6505 - DNA, 1462 bp, Paracoccus siganidrum
  ref <308>: DATABASE ACCESSION NUMBER: NCBI ACCESSION: NZ_QNRC01000071.1
  ref <309>: DATABASE ENTRY DATE: 2019-04-01
  ref <313>: RELEVANT RESIDUES IN SEQ ID NO: (1)..(1462)
tcaacttgagagtttgatcctggctcagaacgaacgctggcggcaggcctaacacatgcaagtcgagcgaacccttcggggttagcggcggacgggtgagtaacgcgtgggaatgtgcccttctctacggaatagtcctgggaaactgggggtaataccgtatacgccctttgggggaaagatttatcggagaaggatcagcccgcgttggattaggtagttggtggggtaatggcctaccaagcctacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagttgggggtgaaatcccggggctcaaccccggaactgccttcaaaactatcagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggaccgccggagagatccggttttctcgtaagagacctgtggacaggtgctgcatggctgtcgtcagctcgtgtcgtgagatgttcggttaagtccggcaacgagcgcaacccacgtccccagttgccagcattcagttgggcactctgtggaaactgccggtgataagccggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctccttt

SEQ ID NO: 6506 - DNA, 1465 bp, Paracoccus solventivorans
  ref <308>: DATABASE ACCESSION NUMBER: NCBI ACCESSION: NZ_FRCK01000021.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgcaccttcgggtgagcggcggacgggtgagtatcgcgtgggaacgtgcccttctctacggaatagtcctgggaaactgggggtaataccgtatacgccctttgggggaaagatttatcggagaaggatcggcccgcgttggattaggtagttggtggggtaatggctcaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgtgaagataatgacggtagcagcagaagaagtcccggctaactccgtgccagcagccgcggtaatacggaggggactagcgttgttcggaattactgggcgtaaagcgcacgtaggcggatcggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccccggacagctccagagatggagtctccacttcggtggccgggtgacaggtgctgcatggctgtcgtcagctcgtgtcgtgagatgttcggttaagtccggcaacgagcgcaacccacgtccccagttgccagcattcagttgggcactctgtggaaactgccgatgataagtcggaggaaggtgtggatgacgtcaagtcctcatggcccttacgggttgggctacacacgtgctacaatggtggtgacaatgggttaatccccaaaagccatctcagttcggattgtcgtctgcaactcgacggcatgaagttggaatcgctagtaatcgcgtaacagcatgacgcggtgaatacgttcccgggccttgtacacaccgcccgtcacaccatgggagttggttctacccgacggccgtgcgctaacccttacgggaggcagcggaccacggtaggatcagcgactggggtgaagtcgtaacaaggtagccgtaggggaacctgcggctggatcacctcctttctaa

SEQ ID NO: 6507 - DNA, 1466 bp, Paracoccus sp. 1011MAR3C25
  ref <308>: DATABASE ACCESSION NUMBER: NCBI ACCESSION: NZ_QZCG01000033.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcttaacacatgcaagtcgagcgagaccttcgggtttagcggcggacgggtgagtaacgcgtgggaacgtgcccttttctacggaatagcccagggaaacttggattaataccgtatacgcccttttggggaaagatttatcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaaccccggaactgcctccaaaactatcagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgcaccggagacggtgttttctcgtaagagaccaggagacaggtgctgcatggctgtcgtcagctcgtgtcgtgagatgttcggttaagtccggcaacgagcgcaacccacgtccctagttgccagcagttcggctgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaacctttcggaggcagcggaccacggtaggatcagcgactggggtgaagtcgtaacaaggtagccgtaggggaacctgcggctggatcacctcctttctaa

SEQ ID NO: 6508 - DNA, 1465 bp, Paracoccus sp. 228
  ref <308>: DATABASE ACCESSION NUMBER: NCBI ACCESSION: NZ_JYGY01000002.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgagaccttcgggtctagcggcggacgggtgagtaacgcgtgggaacgtacccttctctacggaatagccccgggaaactgggagtaataccgtatacgccctttgggggaaagatttatcggagaaggatcggcccgcgttggattaggtagttggtggggtaatggcccaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttcta

SEQ ID NO: 6509 - DNA, 1464 bp, Paracoccus sp. 4-2
  ref <308>: DATABASE ACCESSION NUMBER: NCBI ACCESSION: NZ_QOKZ01000030.1
  ref <309>: DATABASE ENTRY DATE: 2019-04-01
  ref <313>: RELEVANT RESIDUES IN SEQ ID NO: (1)..(1464)
caacttgagagtttgatcctggctcagaacgaacgctggcggcaggcctaacacatgcaagtcgagcgagaccttcgggtttagcggcggacgggtgagtaacgcgtgggaatatgcccttcactacggaatagcccagggaaacttggattaataccgtatacgcccttcgggggaaagaatttcggtgaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcatgtaggcggacaggaaagttgggggtgaaatcccggggctcaaccccggaactgccttcaaaactatctgtctggagttcgagagaggtgagtggaattccgagtgtagaggtgaaattcgtagatattcggaggaacaccagtggcgaaggcggctcactggctcgatactgacgctgagatgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgtcggagagatccgactttctcgtaagagaccaggagacaggtgctgcatggctgtcgtcagctcgtgtcgtgagatgttcggttaagtccggcaacgagcgcaacccacgtccccagttgccagcattcagttgggcactctgtggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 6510 - DNA, 1466 bp, Paracoccus sp. Arc7-R13
  ref <308>: DATABASE ACCESSION NUMBER: NCBI ACCESSION: NZ_CP034810.1
  ref <309>: DATABASE ENTRY DATE: 2019-04-01
  ref <313>: RELEVANT RESIDUES IN SEQ ID NO: (1)..(1466)
ggtttcaacttgagagtttgatcctggctcagaacgaacgctggcggcaggcttaacacatgcaagtcgagcgagaccttcgggtctagcggcggacgggtgagtaacgcgtgggaacgtgcccttctctacggaatagccccgggaaactgggagtaataccgtatacgccctttgggggaaagatttatcggagaaggatcggcccgcgttggattaggtagttggtggggtaatggcccaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctccttt

SEQ ID NO: 6511 - DNA, 1470 bp, Paracoccus sp. BM15
  ref <308>: DATABASE ACCESSION NUMBER: NCBI ACCESSION: NZ_CP025408.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgagaccttcgggtctagcggcggacgggtgagtaacgcgtgggaatatgcccttctctacggaatagtctcgggaaactgggggtaataccgtatacgcccttttggggaaagatttatcggagaaggattagcccgcgttggattaggtagttggtggggtaacggcctaccaagcctacgatccatagctggtttgagaggatgatcagccacactgggactgagacacggcccagactcctacgggaggcagcagtggggaatcttagacaatgggggaaaccctgatctagccatgccgcgtgagtgatgaaggccttagggttgtaaagctctttcagctgggaagataatgacggtaccagcagaagaagtcccggctaactccgtgccagcagccgcggtaatacggaggggactagcgttgttcggaattactgggcgtaaagcgcacgtaggcggactggaaagttgggggtgaaatcccggggctcaaccccggaactgcctccaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgctggagagatccagctttctcgtaagagaccgagtgacaggtgctgcatggctgtcgtcagctcgtgtcgtgagatgttcggttaagtccggcaacgagcgcaacccacgtccctagttgccagcaggttaagctgggcactctatggaaactgccgatgataagtcggaggaaggtgtggatgacgtcaagtcctcatggcccttacgggttgggctacacacgtgctacaatggtagtgacaatgggttaatccccaaaagctatctcagttcggattggggtctgcaactcgaccccatgaagttggaatcgctagtaatcgcggaacagcatgccgcggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 6512 - DNA, 1469 bp, Paracoccus sp. CBA4604
  ref <308>: DATABASE ACCESSION NUMBER: NCBI ACCESSION: NZ_CP025583.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgaacccttcgggggttagcggcggacgggtgagtaacgcgtgggaatgtgcccttctctacggaatagtcctgggaaactgggggtaataccgtatacgccctattggggaaagatttatcggagaaggatcagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagcaagttaggggtgaaatcccgggggctcaacctcggaactgcccttaaaactgttgatctggagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggacagcgccagagatggcgtcttcacttcggtgacccggagacaggtgctgcatggctgtcgtcagctcgtgtcgtgagatgttcggttaagtccggcaacgagcgcaacccacgtccccagttgccagcattcagttgggcactctgtggaaactgccgatgataagtcggaggaaggtgtggatgacgtcaagtcctcatggcccttacgggttgggctacacacgtgctacaatggtggtgacagcgggttaatcccgaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaacccttacgggaggcagcggaccacggtaggatcagcgactggggtgaagtcgtaacaaggtagccgtaggggaacctgcggctggatcacctcctttctaa

SEQ ID NO: 6513 - DNA, 1464 bp, Paracoccus sp. DSL-16
  ref <308>: DATABASE ACCESSION NUMBER: NCBI ACCESSION: NZ_QJPK01000065.1
  ref <309>: DATABASE ENTRY DATE: 2019-04-01
  ref <313>: RELEVANT RESIDUES IN SEQ ID NO: (1)..(1464)
tcaacttgagagtttgatcctggctcagaacgaacgctggcggcaggcttaacacatgcaagtcgagcgagatcttcggatctagcggcggacgggtgagtaacgcgtgggaacgtgccctttgctacggaatagtcccgggaaactgggtttaataccgtatacgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcggaaagttgggggtgaaatcccggggctcaacctcggaactgcctccaaaactatcggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctccttt

SEQ ID NO: 6514 - DNA, 1467 bp, Paracoccus sp. J39
  ref <308>: DATABASE ACCESSION NUMBER: NCBI ACCESSION: NZ_JAEN01000045.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatacgcccttagggggaaagatttatcggcaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaacctcggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccccggaccggcctggagacaggtcttccacttcggtggccgggtgacaggtgctgcatggctgtcgtcagctcgtgtcgtgagatgttcggttaagtccggcaacgagcgcaacccacactcttagttgccagcatttggttgggcactctaagagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatgggggcagcggaccacggtaggctcagcgactggggtgaagtcgtaacaaggtagccgtaggggaacctgcggctggatcacctcctttctaa

SEQ ID NO: 6515 - DNA, 1467 bp, Paracoccus sp. J55; identical to SEQ ID NO: 6514
  ref <308>: DATABASE ACCESSION NUMBER: NCBI ACCESSION: NZ_AZVA01000061.1
  ref <309>: DATABASE ENTRY DATE: 2019-04-01
  ref <313>: RELEVANT RESIDUES IN SEQ ID NO: (1)..(1467)

SEQ ID NO: 6516 - DNA, 1481 bp, Paracoccus sp. J56
  ref <308>: DATABASE ACCESSION NUMBER: NCBI ACCESSION: NZ_FXAQ01000056.1
  ref <309>: DATABASE ENTRY DATE: 2019-04-01
  ref <313>: RELEVANT RESIDUES IN SEQ ID NO: (1)..(1481)
caacttgagagtttgatcctggctcagaacgaacgctggcggcaggcctaacacatgcaagtcgagcgaggacttcggtcctagcggcggacgggtgagtaacgcgtgggaacgtgccccttgctgcggaatagccccgggaaactgggattaataccgcatgatccccctgatcatggagatctgggggcaaagatttatcggcaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgactgtaccagcagaagaagccccggctaactccgtgccagcagccgcggtaatacggagggggctagcgttgttcggaattactgggcgtaaagcgcacgtaggcggaccggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggacagcccgagagatcgggtctccacttcggtggcctggagacaggtgctgcatggctgtcgtcagctcgtgtcgtgagatgttcggttaagtccggcaacgagcgcaacccacactcctagttgccatcatttggttgggcactctaggagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatggaggcagcggaccacggtaggctcagcgactggggtgaagtcgtaacaaggtagccgtaggggaacctgcggctggatcacctcctttcta

SEQ ID NO: 6517 - DNA, 1466 bp, Paracoccus sp. JM45
  ref <308>: DATABASE ACCESSION NUMBER: NCBI ACCESSION: NZ_QQVY01000005.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcttaacacatgcaagtcgagcgagatcttcggatctagcggcggacgggtgagtaacgcgtgggaacgtgccctttgctacggaatagtcccgggaaactgggtttaataccgtatacgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaacctcggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcggctccggagacggagctttcagttcggctggatatcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatcccaaaaagccatctcagttcggattgttctctgcaactcgagagcatgaagttggaatcgctagtaatcgcggaacagcatgccgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttcta

SEQ ID NO: 6518 - DNA, 1467 bp, Paracoccus sp. M1-83
  ref <308>: DATABASE ACCESSION NUMBER: NCBI ACCESSION: NZ_UZWE01000034.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcggacccttcggggttagcggcggacgggtgagtaacgcgtgggaatatgcccttctctacggaatagtctcgggaaactgggggtaataccgtatacgccctttgggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcggaaagttgggggtgaaatcccggggctcaacctcggaactgccttcaaaactatcggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggacatccccagagatggggcttccacttcggtggcctggagacaggtgctgcatggctgtcgtcagctcgtgtcgtgagatgttcggttaagtccggcaacgagcgcaacccacgtccccagttgccagcattcagttgggcactctgtggaaactgccggtgataagccggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttgggtctacccgacggccgtgcgctaacccttacgggaggcagcggaccacggtaggctcagcgactggggtgaagtcgtaacaaggtagccgtaggggaacctgcggctggatcacctcctttctaa

SEQ ID NO: 6519 - DNA, 1468 bp, Paracoccus sp. N5
  ref <308>: DATABASE ACCESSION NUMBER: NCBI ACCESSION: NZ_AQUO01000001.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgagcgaggacttcggttctagcggcggacgggtgagtaacgcgtgggaacgtgcccttctctacggaatagccctgggaaactgggagtaataccgtatacgccccttgggggaaagatttatcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaacctcggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggaccgcccgagagatcgggttttctcgtaagagacctgtggacaggtgctgcatggctgtcgtcagctcgtgtcgtgagatgttcggttaagtccggcaacgagcgcaacccacacttccagttgccatcatttggttgggcactctggaagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttggttctacccgacggccgtgcgctaaccagcaatgggggcagcggaccacggtaggatcagcgactggggtgaagtcgtaacaaggtagccgtaggggaacctgcggctggatcacctcctttctaa

SEQ ID NO: 6520 - DNA, 1467 bp, Paracoccus sp. PAMC 22219
  ref <308>: DATABASE ACCESSION NUMBER: NCBI ACCESSION: NZ_BBPH01000068.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgagcgagatcttcggatctagcggcggacgggtgagtaacgcgtgggaacgtgcccttctctacggaatagccccgggaaactgggagtaataccgtatacgccctttgggggaaagatttatcggagaaggatcggcccgcgttggattaggtagttggtgaggtaacggctcaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttcta

SEQ ID NO: 6521 - DNA, 1467 bp, Paracoccus sp. SM22M-07
  ref <308>: DATABASE ACCESSION NUMBER: NCBI ACCESSION: NZ_JPKW01000008.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgagcgagatcttcggatctagcggcggacgggtgagtaacgcgtgggaacgtgccctttgctacggaatagtcccgggaaactgggtttaataccgtatacgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcggaaagttgggggtgaaatcccggggctcaacctcggaactgcctccaaaactatcggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcaggaccgctggagagattcagctttctcgtaagagacctgcacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaacctctcgagggggcaggcggccacggtaggatcagcgactggggtgaagtcgtaacaaggtagccgtaggggaacctgcggctggatcacctcctttcta

SEQ ID NO: 6522 - DNA, 1467 bp, Paracoccus sp. SY
  ref <308>: DATABASE ACCESSION NUMBER: NCBI ACCESSION: NZ_NWMQ01000087.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcggacctttcggggtcagcggcggacgggtgagtaacgcgtgggaatatgcccttctctacggaatagtcctgggaaactgggggtaataccgtatacgccctttgggggaaagatttatcggggaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcggaaagttgggggtgaaatcccggggctcaacctcggaactgccttcaaaactactggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggaccgcccgagagatcgggtttccacttcggtggcctggagacaggtgctgcatggctgtcgtcagctcgtgtcgtgagatgttcggttaagtccggcaacgagcgcaacccacgtccccagttgccagcattcagttgggcactctgtggaaactgccggtgataagccggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcacgccgcggtgaatacgttcccgggccttgtacacaccgcccgtcacaccatgggagttgggtctacccgacggccgtgcgctaaccctcgcgggaggcagcggaccacggtaggctcagcgactggggtgaagtcgtaacaaggtagccgtaggggaacctgcggctggatcacctcctttctaa

SEQ ID NO: 6523 - DNA, 1113 bp, Paracoccus sp. TRP
  ref <308>: DATABASE ACCESSION NUMBER: NCBI ACCESSION: NZ_AEPN01000031.1
  ref <309>: DATABASE ENTRY DATE: 2019-04-01
  ref <313>: RELEVANT RESIDUES IN SEQ ID NO: (1)..(1113)
tcaacttgagagtttgatcctggctcagaacgaacgctggcggcaggcctaacacatgcaagtcgagcgaggacttcggtcctagcggcggacgggggggtaacgcgtgggaacgtgccccttgctgcggaatagccccgggaaactgggattaataccgcatgatccccctgatcatggagatctgggggcaaagatttatcggcaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgactgtaccagcagaagaagccccggctaactccgtgccagcagccgcggtaatacggagggggctagcgttgttcggaattactgggcgtaaagcgcacgtaggcggaccggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggacagcccgagagatcgggtctccacttcggtggcctggagacaggtgctgcatggctgtcgtcagctcgtgtcgtgagatgttcggttaagtccggcaacgagcgcaacccacactcctagttgccatcatttggttgggcactctaggaga

SEQ ID NO: 6524 - DNA, 1465 bp, Paracoccus sphaerophysae
  ref <308>: DATABASE ACCESSION NUMBER: NCBI ACCESSION: NZ_JRKS01000111.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgcgccttcgggtgagcggcggacgggtgagtaacacgtgggaatatgcctttcggtgcggaatagtcttgggaaactgagggtaataccgcatacgccccttgggggaaagatttatcgccgaaagattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactattggtctggagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggacaactccagagatggagcttccacttcggtggccgagtgacaggtgctgcatggctgtcgtcagctcgtgtcgtgagatgttcggttaagtccggcaacgagcgcaacccacactttcagttgccatcattcagttgggcactctggaagaactgccggtgataagccggaggaaggtgtggatgacgtcaagtcctcatggcccttacgggttgggctacacacgtgctacaatggtggtgacagtgggttaatccccaaaagccatctcagttcggattgtcgtctgcaactcgacggcatgaagttggaatcgctagtaatcgcgtaacagcatgacgcggtgaatacgttcccgggccttgtacacaccgcccgtcacaccatgggagttgggtctacccgacggccgtgcgctaacccttacgggaggcagcggaccacggtaggctcagcgactggggtgaagtcgtaacaaggtagccgtaggggaacctgcggctggatcacctcctttctaa

SEQ ID NO: 6525 - DNA, 1466 bp, Paracoccus thiocyanatus
  ref <308>: DATABASE ACCESSION NUMBER: NCBI ACCESSION: NZ_QFCQ01000145.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgcgcccttcggggtgagcggcggacgggtgagtaacgcgtgggaacgtgccctttgctacggaatagtcctgggaaactgggggtaataccgtatacgccctattggggaaagatttatcggcgaaggatcggcccgcgttggattaggtagttggtggggtaatggctcaccaagccgacgatccatagctggtttgagaggatgatcagcacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggacctgaaagttgggggtgaaatcccggggctcaacctcggaactgccttcaaaactacgggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggaccgcccgagagatcgggttttctcgtaagagacctgtggacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgccaacccgcaaggggggcagcggaccacggtaggctcagcgactggggtgaagtcgtaacaaggtagccgtaggggaacctgcggctggatcacctcctttctaa

SEQ ID NO: 6526 - DNA, 1465 bp, Paracoccus versutus
  ref <308>: DATABASE ACCESSION NUMBER: NCBI ACCESSION: NZ_QUMX01000089.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgcgccttcgggtgagcggcggacgggtgagtaacgcgtgggaatatgccctttggtacggaatagtcctgggaaactgggggtaataccgtatgcgcccttcgggggaaagatttatcgccaaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccggaaagttgggggtgaaatcccggggctcaaccccggaactgccttcaaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccaggaccggcccggagacgggtctttcacttcggtgacctggagacaggtgctgcatggctgtcgtcagctcgtgtcgtgagatgttcggttaagtccggcaacgagcgcaacccacacttccagttgccatcatttggttgggcactctggaagaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgctaaccagcaatgggggcagcggaccacggtaggctcagcgactggggtgaagtcgtaacaaggtagccgtaggggaacctgcggctggatcacctcctttctaa

SEQ ID NO: 6527 - DNA, 1468 bp, Paracoccus yeei
  ref <308>: DATABASE ACCESSION NUMBER: NCBI ACCESSION: NZ_CP031078.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgagcgaggacttcggttctagcggcggacgggtgagtaacgcgtgggaatgtgcccttctctacggaatagccctgggaaactgggagtaataccgtatacgccctattggggaaagatttatcggagaaggatcagcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccggaaagtcagaggtgaaatcccagggctcaaccttggaactgcctttgaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggacagcccgagagatcgggtcttctcgtaagagacctgtggacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggtggtgacagtgggttaatccccaaaagccatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgccaaccagcaatggaggcagcggaccacggtaggctcagcgactggggtgaagtcgtaacaaggtagccgtaggggaacctgcggctggatcacctcctttctaa

SEQ ID NO: 6528 - DNA, 762 bp, Paracoccus zeaxanthinifaciens
  ref <308>: DATABASE ACCESSION NUMBER: NCBI ACCESSION: NZ_ATUJ01000028.1
  ref <309>: DATABASE ENTRY DATE: 2019-04-01
  ref <313>: RELEVANT RESIDUES IN SEQ ID NO: (1)..(762)
gcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggacatcccgagagatcgggctttcacttcggtgaccaggagacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 6529 - DNA, 1469 bp, Paracoccus zhejiangensis
  ref <308>: DATABASE ACCESSION NUMBER: NCBI ACCESSION: NZ_CP025430.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgggaccttcgggtctagcggcggacgggtgagtatcgcgtgggaatatgcccttctctacggaatagcctcgggaaactgagagtaataccgtatacgcccttcgggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagttgggggtgaaatcccggggctcaacctcggaactgccttcaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgcaggacagctccagagatggagtcttctcgtaagagacctgcagacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagttggaatcgctagtaatcgcggaacagcatgccgcggtgaatacgttcccgggccttgtacacaccgcccgtcacaccatgggagttgggtctacccgacggccgtgcgccaacctggtaacaggaggcagcggaccacggtaggctcagcgactggggtgaagtcgtaacaaggtagccgtaggggaacctgcggctggatcacctcctttctaa

SEQ ID NO: 6530 - DNA, 1520 bp, Paraeggerthella hongkongensis
  ref <308>: DATABASE ACCESSION NUMBER: NCBI ACCESSION: NZ_QICD01000049.1
  ref <309>: DATABASE ENTRY DATE: 2019-04-01
  ref <313>: RELEVANT RESIDUES IN SEQ ID NO: (1)..(1520)
tttaaacggagagtttgatcctggctcaggatgaacgctggcggcgtgcctaacacatgcaagtcgaacggttaacccaccttcgggtggtcatacagtggcgaacgggtgagtaacacgtgaccaacctgcccccctctccgggacaacctcgggaaaccgtggctaataccggatgctccttcccctccgcatggaggggtcgggaaagcccaggcggagggggatggggtcgcggcccatcaggtagacggcggggtagcggcccaccgtgctttcgacgggtagccgggttgagagaccgaccggccacattgggactgagatacggcccagactcctacgggaggcagcagtggggaattttgcgcaatgggggaaaccctgacgcagcaacgccgcgtgcgggaagacggccttcgggttgtaaaccgctttcagcagggaagaccgacgacggtacctgcagaagaagccccggctaactacgtgccagcagccgcggtaatacgtagggggcgagcgttatccggattcattgggcgtaaagcgcgcgtaggcggcgcgccaagcggaacctctaacctcggggctcaacctcgagccgggttccgaactggcgcgctcgagttcggtagaggcaggcggaattcccggtgtagcggtggaatgcgcagatatcgggaagaacaccgatggcgaaggcagcctgctgggccgacactgacgctgaggtgcgaaagctaggggagcgaacaggattagataccctggtagtcctagccgtaaacgatggacgctaggtgtggggaggatcgcctctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgagtgaagccggggagacccggtggccgagaggagctcgcgcaggtggtgcatggctgtcgtcagctcgtgtcgtgagatgttgggttaagtcccgcaacgagcgcaacccctgccgtatgttgccagcattgagttggggactcatacgggactgccggcgtcaagccggaggaaggtggggacgacgtcaagtcatcatgccctttatgccctgggctgcacacgtgctacaatggccggtacaacgggctgcgacctggcgacaggaagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacctcctttctagggag

SEQ ID NO: 6531 - DNA, 1049 bp, Parageobacillus caldoxylosilyticus
  ref <308>: DATABASE ACCESSION NUMBER: NCBI ACCESSION: NZ_LQYS01000056.1
  ref <309>: DATABASE ENTRY DATE: 2019-04-01
  ref <313>: RELEVANT RESIDUES IN SEQ ID NO: (1)..(1049)
ttctatggagagtttgatcctggctcaggacgaacgctggcggcgtgcctaatacatgcaagtcgagcggaccgagcaggagcttgctcttgttcggttagcggcggacgggtgagtaacacgtgggtaacctacccgtaagaccgggataactccgggaaaccggagctaataccggataacaccaaagaccgcatggtctttggttgaaaggcggcttcggctgtcacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggccattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggtcaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcggggg

SEQ ID NO: 6532 - DNA, 1563 bp, Parageobacillus genomosp. 1
  ref <308>: DATABASE ACCESSION NUMBER: NCBI ACCESSION: NZ_CM002692.1
  ref <309>: DATABASE ENTRY DATE: 2019-04-01
  ref <313>: RELEVANT RESIDUES IN SEQ ID NO: (1)..(1563)
ttctatggagagtttgatcctggctcaggacgaacgctggcggcgtgcctaatacatgcaagtcgagcggaccgaacaggagcttgctcttgttcggttagcggcggacgggtgagtaacacgtgggcaacctacccgtaagaccgggataactccgggaaaccggagctaataccggataacaccgaagaccgcatggtctttggttgaaaggcggctttggctgtcacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggtcaaaccctttagtgctgcagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctagagatagggcgttcccccttcgggggggacagggtgacaggtggtgcatggttgtcgtcagctcgtgtcgtgagatgttgggttaagtcccgcaacgagcgcaaccctcgaccttagttgccagcattcagttgggcactctaaggtgactgccgatgacaaatcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgtttgggagccagccgccgaaggtggggcaagtgattggggtgaagtcgtaacaaggtagccgtaccggaaggtgcggctggatcacctcctttctaa

SEQ ID NO: 6533 - DNA, 1035 bp, Parageobacillus thermantarcticus
  ref <308>: DATABASE ACCESSION NUMBER: NCBI ACCESSION: NZ_FOJS01000106.1
  ref <309>: DATABASE ENTRY DATE: 2019-04-01
  ref <313>: RELEVANT RESIDUES IN SEQ ID NO: (1)..(1035)
tggagagtttgatcctggctcaggacgaacgctggcggcgtgcctaatacatgcaagtcgagcggaccaaacaggagcttgctcttgtttggttagcggcggacgggtgagtaacacgtgggtaacctgcccgtaagaccgggataactccgggaaaccggagctaataccggataacaccgaagaccgcatggtctttggttgaaaggcggcttcggctgccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagcgtcgttcgaacagggcggcgcggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggcttaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttttccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttccccc

SEQ ID NO: 6534 - DNA, 1560 bp, Parageobacillus toebii
  ref <308>: DATABASE ACCESSION NUMBER: NCBI ACCESSION: NZ_RCWX01000001.1
  ref <309>: DATABASE ENTRY DATE: 2019-04-01
  ref <313>: RELEVANT RESIDUES IN SEQ ID NO: (1)..(1560)
tttttggagagtttgatcctggctcaggacgaacgctggcggcgtgcctaatacatgcaagtcgagcggaccgaacggaagcttgcttctgttcggttagcggcggacgggtgagtaacacgtgggtaacctgcccgtaagaccgggataactccgggaaaccggggctaataccggataacaccgaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcggggggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaaccctttaagggagccagccgccgaaggtggggcaagtgattggggtgaagtcgtaacaaggtagccgtaccggaaggtgcggctggatcacctcctttct

SEQ ID NO: 6535 - DNA, 1538 bp, Parahaliea mediterranea
  ref <308>: DATABASE ACCESSION NUMBER: NCBI ACCESSION: NZ_QEWO01000003.1
  ref <309>: DATABASE ENTRY DATE: 2019-04-01
  ref <313>: RELEVANT RESIDUES IN SEQ ID NO: (1)..(1538)
taaactgaagagtttgatcatggctcagattgaacgctggcggcaggcctaacacatgcaagtcgagcgcgaaagcccttcggggtgagtagagcggcggacgggtgagtaacgcgtaggaatctacctggtagtgggggacaacatggggaaactcatgctaataccgcatacgccctacgggggaaagcgggggaccttcgggcctcgcgctatcagatgagcctgcgttggattagctagttggtgaggtaagggctcaccaaggcgacgatccatagctggtctgagaggatgatcagccacaccgggactgagacacggcccggactcctacgggaggcagcagtggggaatattgcgcaatgggcgaaagcctgacgcagccatgccgcgtgtgtgaagaaggccttcgggttgtaaagcactttcacttgggaagaaaggttgcgtgttaatagcgcgtaactgtgacattaccttgagaagaagcaccggctaactccgtgccagcagccgcggtaatacggagggtgcgagcgttaatcggaattactgggcgtaaagcgcgcgtaggcggtttgttaagtcggatgtgaaagccccgggctcaacctgggaactgcacccgatactggccgactagagtacgagagagggaggtagaattccacgtgtagcggtgaaatgcgtagatatgtggaggaataccggtggcgaaggcggcctcctggctcgatactgacgctgaggtgcgaaagcgtggggagcaaacaggattagataccctggtagtccacgccgtaaacgatgtctactagccgttggggaacttgagtccttggtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggccttgacatccttggaagttggcggagacgccttcgtgccttcgggagccaagtgacaggtgctgcatggctgtcgtcagctcgtgtcgtgagatgttgggttaagtcccgtaacgagcgcaacccctgtccctagttgctagcaggttaagctgagaactctagggagactgacggtgacaaaccgtaggaaggtggggacgacgtcaagtcatcatggcccttacggcctgggctacacacgtgctacaatggaacgcacagagggcagcaaacccgcgagggggagcgaatcccacaaaacgtttcgtagtccggattggagtctgcaactcgactccatgaagtcggaatcgctagtaatcgtgaatcagaatgtcacggtgaatacgttcccgggccttgtacacaccgcccgtcacaccatgggagtgggttgctccagaagtggttagcctaaccttcgggagggcgatcaccacggagtgattcatgactggggtgaagtcgtaacaaggtagccctaggggaacctggggctggatcacctccttaaac

SEQ ID NO: 6536 - DNA, 1569 bp, Paraliobacillus ryukyuensis
  ref <308>: DATABASE ACCESSION NUMBER: NCBI ACCESSION: NZ_FVZO01000017.1
  ref <309>: DATABASE ENTRY DATE: 2019-04-01
  ref <313>: RELEVANT RESIDUES IN SEQ ID NO: (1)..(1569)
tttatggagagtttgatcttggctcaggacgaacgctggcggcgtgcctaatacatgcaagtcgagcgcgggaagcaagaagaatccttcgggaggattcttgtggaacgagcggcggacgggtgagtaacacgtgggcaacctgcctgtaagactgggataactccgggaaaccggagctaataccggataaaacgttggttcgcatgaaccaatgatgaaaggcggcttttagctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttcaaatagggcggtaccttgacggtacctaacgaggaagccccggctaactacgtgccagcagccgcggtaatacgtagggggcaagcgttgtccggaattattgggcgtaaagcgcacgcaggcggttctttaagtctgatgtgaaatcttgtggctcaaccacaagcggtcattggaaactggggaacttgagtgcagaagaggagagtggaattccacgtgtagcggtgaaatgcgtagatatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgctccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgacagccctagagatagggtgtccccttcgggggcagcgtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 6537 - DNA, 1498 bp, Paramesorhizobium deserti
  ref <308>: DATABASE ACCESSION NUMBER: NCBI ACCESSION: NZ_LNTU01000001.1
  ref <309>: DATABASE ENTRY DATE: 2019-04-01
  ref <313>: RELEVANT RESIDUES IN SEQ ID NO: (1)..(1498)
ttcaacttgagagtttgatcctggctcagaacgaacgctggcggcaggcttaacacatgcaagtcgaacgccctcttcggagggagtggcagacgggtgagtaacgcgtgggaatctacccatctctacggaacaactccgggaaactggagctaataccgtatacgtccttttggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcgggtaggagagatcctatccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgggtgcatgaagttggaatcgctagtaatcgtggatcagcatgccacggtgaatacgttcccgggccttgtacacaccgcccgtcacaccatgggagttggctttacccgaaggtgctgtgctaaccgcaaggaggcaggcaaccacggtagggtcagcgactggggtgaagtcgtaacaaggtagccgtaggggaacctgcggctggatcacctcctttctaaggaag

SEQ ID NO: 6538 - DNA, 1526 bp, Parapedobacter composti
  ref <308>: DATABASE ACCESSION NUMBER: NCBI ACCESSION: NZ_FOLL01000040.1
  ref <309>: DATABASE ENTRY DATE: 2019-04-01
  ref <313>: RELEVANT RESIDUES IN SEQ ID NO: (1)..(1526)
tacaatggagagtttgatcctggctcaggatgaacgctagcggcaggcctaatacatgcaagtcgaacgggattcactccttcgggggtgatgagagtggcgcacgggtgcgtaacgcgtgagcaacctgcccgtcccagggggatagcccctcgaaagagggattaacaccgcatgacgttgttccatggcatcgtgggacaaccaaatattgataggggacggatgggctcgcgtggcattagctagttggtagggtaacggcttaccaaggcgacgatgcctaggggctctgagaggagaatcccccacactggtactgagacacggaccagactcctacgggaggcagcagtaaggaatattggtcaatgggcgcaagcctgaaccagccatgccgcgtgcaggaggacggccctatgggttgtaaactgcttttgcaggggaacaaaccccggtacgtgtaccgggctgagtgtaccctgagaataaggatcggctaactccgtgccagcagccgcggtaatacggaggatccgagcgttatccggatttattgggtttaaagggtgcgtaggcggcgtgctaagtcagtggtgaaagacggtggctcaaccatcgcagtgccgttgatactggcgcgcttgaattcggatgaggtaggcggaatgtggcaagtagcggtgaaatgcatagatatgccacagaacaccgatcgcgaaggcagcttaccaaggcgatattgacgctgatgcacgaaagcgtggggatcgaacaggattagataccctggtagtccacgccctaaacgatgatgactcgatgtcggcgatagaatgccggtgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttagcgacggcaccagagatggtgcttcccttcggggcgcgaaactaggtgctgcatggctgtcgtcagctcgtgccgtgaggtgttgggttaagtcccgcaacgagcgcaacccctgtggatagttgccagcatgtaacggtggggactctatccagactgcctgcgcaagcagtgaggaaggcggggacgacgtcaagtcatcatggcccttacgtccggggctacacacgtgctacaatggtcggtacagcgggcagccacccagcgatggggcgccaatcccgcaaagccggtcacagttcggatcggggcctgcaactcggccccgtgaagttggattcgctagtaatcgcgtatcagcaatgacgcggtgaatacgttcccgggccttgtacacaccgcccgtcaagccatgaaagccgggggtgcctgaagcatgtgaccgcaaggagcgtgtcagggcaaaactggtaattggggctaagtcgtaacaaggtagccgtaccggaaggtgcggctggaatacctcctttcta

SEQ ID NO: 6539 - DNA, 1522 bp, Parapedobacter indicus
  ref <308>: DATABASE ACCESSION NUMBER: NCBI ACCESSION: NZ_FOQO01000023.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacgggatccaccagcttgctggtggtgagagtggcgcacgggtgcgtaacgcgtgagcaacctgcccgtcccagggggatagcccctcgaaagagggattaacaccgcatgaagttatataccggcatcggttgtataaccaaatatttataggggacggatgggctcgcgtggcattagctagttggtagggtaacggcttaccaaggctatgatgcctaggggctctgagaggagaatcccccacactggtactgagacacggaccagactcctacgggaggcagcagtaaggaatattggtcaatgggcgggagcctgaaccagccatgccgcgtgcaggaggactgccctacgggttgtaaactgcttttgtacgggaacaaacccctttacgagtagagggttgagtgtaccgtaagaataaggatcggctaactccgtgccagcagccgcggtaatacggaggatccgagcgttatccggatttattgggtttaaagggtgcgtaggcggcatgctaagtcaggggtgaaagacggtggctcaaccatcgcagtgcctttgatactggtgtgcttgaatgcggatgaggtaggcggaatgtggcaagtagcggtgaaatgcatagatatgccacagaacaccgattgcgaaggcagcttaccaaggcgcgattgacgctgatgcacgaaagcgtggggatcgaacaggattagataccctggtagtccacgccctaaacgatgatgactcggtgtcggcgatagaatgccggcgcccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttagtgaattatccagagatggataagtccttcgggacacgaaactaggtgctgcatggctgtcgtcagctcgtgccgtgaggtgttgggttaagtcccgcaacgagcgcaacccctgtggatagttgccagcatttaaaggtggggactctatccagactgcctgtgcaaacagtgaggaaggcggggacgacgtcaagtcatcatggcccttacgtccggggctacacacgtgctacaatggtcggtacagcgggcagccactcagcaatgaggcgccaatcccgcaaagccgatcacagttcggatcggggcctgcaactcggccccgtgaagttggattcgctagtaatcgcgtatcagcaatgacgcggtgaatacgttcccgggccttgtacacaccgcccgtcaagccatgaaagccgggggtgcctgaagcatgtgaccgcaaggagcgtgtcagggcaaaactggtaattggggctaagtcgtaacaaggtagccgtaccggaaggtgcggctggaatacctcctttcta

SEQ ID NO: 6540 - DNA, 1526 bp, Parapedobacter koreensis
  ref <308>: DATABASE ACCESSION NUMBER: NCBI ACCESSION: NZ_FNZR01000023.1
  ref <309>: DATABASE ENTRY DATE: 2019-04-01
  ref <313>: RELEVANT RESIDUES IN SEQ ID NO: (1)..(1526)
tacaatggagagtttgatcctggctcaggatgaacgctagcggcaggcctaatacatgcaagtcgaacgggattggggagcttgctccccatgagagtggcgcacgggtgcgtaacgcgtgagcaacctgcccgtcccagggggatagcccctcgaaagagggattaacaccgcatgacgttggcttacggcatcgtaaggcaaccaaatattcataggggacggatgggctcgcgtggcattagctagttggtggggtaacggcccaccaaggcgacgatgcctaggggctctgagaggagaatcccccacactggtactgagacacggaccagactcctacgggaggcagcagtaaggaatattggtcaatgggcgggagcctgaaccagccatgccgcgtgcaggaggacggccctacgggttgtaaactgcttttgtacgggaacaaacccctttacgtgtagagggttgagcgtaccgtaagaataaggatcggctaactccgtgccagcagccgcggtaatacggaggatccgagcgttatccggatttattgggtttaaagggtgcgtaggcggcgcgctaagtcaggggtgaaagacggtggctcaaccatcgcagtgcctttgatactggcgcgcttgaatgcggatgaggtaggcggaatgtggcaagtagcggtgaaatgcatagatatgccacagaacaccgattgcgaaggcagcttaccaaggcgcgattgacgctgatgcacgaaagcgtggggatcgaacaggattagataccctggtagtccacgccctaaacgatgatgactcgatgttcgcgatacacggcgagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttagtgaatcacccagagatgggtgagtccttcgggacacgaaactaggtgctgcatggctgtcgtcagctcgtgccgtgaggtgttgggttaagtcccgcaacgagcgcaacccctatggatagttgccagcatttaaaggtggggactctatccagactgcctgcgcaagcagcgaggaaggcggggacgacgtcaagtcatcatggcccttacgtccggggctacacacgtgctacaatgggcggtacagcgggcagccactcagcgatgaggcgccaatcccgcaaagccgttcacagttcggatcggggcctgcaactcggccccgtgaagttggattcgctagtaatcgcgtatcagcaatgacgcggtgaatacgttcccgggccttgtacacaccgcccgtcaagccatgaaagccgggggtgcctgaagcatgttgccgcaaggagcgtgtcagggcaaaactggtgattggggctaagtcgtaacaaggtagccgtaccggaaggtgcggctggaatacctcctttcta

SEQ ID NO: 6541 - DNA, 1539 bp, Paraperlucidibaca baekdonensis
  ref <308>: DATABASE ACCESSION NUMBER: NCBI ACCESSION: NZ_QUNR01000008.1
  ref <309>: DATABASE ENTRY DATE: 2019-04-01
  ref <313>: RELEVANT RESIDUES IN SEQ ID NO: (1)..(1539)
taaactgaagagtttgatcatggctcagattgaacgctggcggcaggcttaacacatgcaagtcgaacgaggtgttggtgcttgcactaacacctagtggcgaacgggtgagtaatacttgggaatctgccttgtagcgggggataacgtttcgaaaggaacgctaataccgcatacgtcctacgggagaaaggaggggatcttcggaccttccactataagatgagcccaagcgagattagctagttggtgaggtaaaggctcaccaaggcgacgatctctagctggtctgagaggatgatcagccacactgggactgagacacggcccagactcctacgggaggcagcagtggggaatattggacaatgggcgaaagcctgatccagccatgccgcgtgtgtgaagaaggccttcgggttgtaaagcactttaagcgaggaggaaatgttctgggttaatacccttgagcagtgacgttactcgcagaataagcaccggctaactctgtgccagcagccgcggtaatacagagggtgcaagcgttaatcggaattactgggcgtaaagcgcgcgtaggcggttacgtaagttggaggtgaaatccccgagctcaacttgggaattgccttcaaaactgcgtggctagagtgtgggagaggaaggtagaattccaggtgtagcggtgaaatgcgtagatatctggaggaataccgatggcgaaggcagccttctggcctaacactgacgctgaggtgcgaaagcatggggagcaaacaggattagataccctggtagtccatgccgtaaacgatgtctactagccgttgggggacttgatcctttagtggcgcagctaacgcattaagtagaccgcctggggagtacggtcgcaagactaaaactcaaatgaattgacgggggcccgcacaagcggtggagcatgtggtttaattcgatgcaacgcgaagaaccttacctagccttgacatgtccggaatcttgcagagatgcgagagtgccttcgggaatcggaacacaggtgctgcatggctgtcgtcagctcgtgtcgtgagatgttgggttaagtcccgcaacgagcgcaacccttgtccttagttgccagcacgtaatggtgggaactctagggagactgccggtgacaaaccggaggaaggcggggacgacgtcaagtcatcatggcccttacggctagggctacacacgtgctacaatggtcggtacaaagggttgccaactcgcgagagtgcgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttactgcaccagaagtaggtagcctaaccgcaaggggggcgcttaccacggtgtggtcaatgactggggtgaagtcgtaacaaggtagccgtaggggaacctgcggctggatcacctccttaa

SEQ ID NO: 6542 - DNA, 1470 bp, Pararhodobacter aggregans
  ref <308>: DATABASE ACCESSION NUMBER: NCBI ACCESSION: NZ_QDDR01000027.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgaagtcttcggacttagcggcggacgggtgagtaacgcgtgggaacgtaccctttggtacggaatagccccgggaaactgggagtaataccgtatggtgtcttcggactaaagatttatcgccaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagtgatgaaggccctagggttgtaaagctctttcagctgggaagataatgacggtaccagcagaagaagccccggctaactccgtgccagcagccgcggtaatacggagggggctagcgttgttcggaattactgggcgtaaagcgcgcgtaggcggactgaaaagttgggggtgaaatcccggggctcaacctcggaactgccttcaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgtagttccgagagatcggttcgtcagttcggctggatatcacacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggtagtgacaatgggataatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggtggtgcgctaacccgcaagggaggcagccaaccacggtaggctcagcgactggggtgaagtcgtaacaaggtagccgtaggggaacctgcggctggatcacctcctttctaa

SEQ ID NO: 6543 - DNA, 1472 bp, Pararhodobacter sp. AM505
  ref <308>: DATABASE ACCESSION NUMBER: NCBI ACCESSION: NZ_QDKM01000023.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcggacgatcccttcggggatagtggcggacgggtgagtaacgcgtgggaatatgcccttctctacggaatagtcctgggaaactgggggtaataccgtatacgcccttcgggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgatgaaggccctagggttgtaaagctctttcagatgggaagataatgacggtaccatcagaagaagccccggctaactccgtgccagcagccgcggtaatacggagggggctagcgttgttcggaattactgggcgtaaagcgcgcgtaggcggattggaaagttagaggtgaaatcccggggctcaaccccggaacggcctttaaaactatcaatctagagttcgagagaggtgagtggaattccgagtgtagaggtgaaattcgtagatattcggaggaacaccagtggcgaaggcggctcactggctcgatactgacgctgaggtgcgaaagcatggggagcaaacaggattagataccctggtagtccatgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgtagttccgagagatcggttcgtcagttcggctggatatcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggtagtgacaatgggataatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggtggtgcgctaacccagcaatgggaggcagccaaccacggtaggttcagcgactggggtgaagtcgtaacaaggtagccgtaggggaacctgcggctggatcacctcctttctaa

SEQ ID NO: 6544 - DNA, 1468 bp, Pararhodobacter sp. CIC4N-9
  ref <308>: DATABASE ACCESSION NUMBER: NCBI ACCESSION: NZ_QEYD01000020.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgagatcttcggatctagcggcggacgggtgagtaacgcgtgggaacgtaccctttgctacggaatagtcccgggaaactgggtttaataccgtatgtgcccttcgggggaaagatttttcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggttgtaaagctctttcagtcgtgaagataatgacggtagcgacagaagaagccccggctaactccgtgccagcagccgcggtaatacggagggggctagcgttgttcggaattactgggcgtaaagcgcgcgtaggcggattggaaagttgggggtgaaatcccggggctcaaccccggaacggcctccaaaactatcagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggtgatcgtagttccgagagatcggttcgtcagttcggctggatcacacacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggcagtgacaatgggataatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagatggtgcgctaacctcttggaggcagccagccacggtaggctcagcgactggggtgaagtcgtaacaaggtagccgtaggggaacctgcggctggatcacctcctttctaa

SEQ ID NO: 6545 - DNA, 1472 bp, Pararhodobacter sp. ZQ420
  ref <308>: DATABASE ACCESSION NUMBER: NCBI ACCESSION: NZ_REEZ01000021.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgatctcttcggagatagcggcggacgggtgagtaacgcgtgggaacataccctttggtacggaatagcctcgggaaactgggagtaataccgtatgtgcccttcgggggaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcgcgtaggcggattggaaagtcagaggtgaaatcccagggctcaaccttggaactgcctttgaaactatcagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgtagttccgggagaccggttcgtcagttcggctggatatcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggtagtgacaatgggataatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggtggtgcgctaacctagcaataggaggcagccaaccacggtaggttcagcgactggggtgaagtcgtaacaaggtagccgtaggggaacctgcggctggatcacctcctttctaa

SEQ ID NO: 6546 - DNA, 1490 bp, Parasaccharibacter apium
  ref <308>: DATABASE ACCESSION NUMBER: NCBI ACCESSION: NZ_LMYH01000022.1
  ref <309>: DATABASE ENTRY DATE: 2019-04-01
  ref <313>: RELEVANT RESIDUES IN SEQ ID NO: (1)..(1490)
tgaacctgagagtttgatcctggctcagagcgaacgctggcggcatgcttaacacatgcaagtcgcacgaacctttcggggttagtggcggacgggtgagtaacgcgtaggaacctatctggaggtgggggataacatcgggaaactggtgctaataccgcatgatgcctgagggccaaaggagagatccgccattggaggggcctgcgttcgattagctagttggttgggtaaaggctgaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcactagggaagatgatgacggtacctagagaagaagccccggctaacttcgtgccagcagccgcggtaatacgaagggggctagcgttgctcggaatgactgggcgtaaagggcgcgtaggctgtttgtacagtcagatgtgaaatccccgggcttaacctgggaactgcatttgatacgtgcagactagagtccgagagagggttgtggaattcccagtgtagaggtgaaattcgtagatattgggaagaacaccggttgcgaaggcggcaacctggctcggaactgacgctgaggcgcgaaagcgtggggagcgaacaggattagataccctggtagtccacgctgtaaacgatgtgtgctggatgttgggtgattttatcattcagtgtcggagctaacgcgttaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtattcagagatggatatttcttcggacctcccgcacaggtgctgcatggctgtcgtcagctcgtgtcgtgagatgttgggttaagtcccgcaacgagcgcaacccttgtctttagttgccatcacgtctgggtgggcactctagagagactgccggtgacaagccggaggaaggtggggatgacgtcaagtcctcatggcccttatgtcctgggctacacacgtgctacaatggcggtgacagagggatgctacatggtgacatggtgctgatctcaaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaagg

SEQ ID NO: 6547 - DNA, 1549 bp, Parascardovia denticolens
  ref <308>: DATABASE ACCESSION NUMBER: NCBI ACCESSION: NZ_UFTI01000003.1
  ref <309>: DATABASE ENTRY DATE: 2019-04-01
  ref <313>: RELEVANT RESIDUES IN SEQ ID NO: (1)..(1549)
ttttgtggagggtttgattctggctcaggacgaacgctggcggcgtgcttaacacatgcaagtcgaacgggatcctgcttggtttttgctgggtgggtgagagtggcgaacgggtgagtaatgcgtgactaacctgccgtgtagttgggtatagctcctggaaacgggtggtaataccgaatggtccactgggctgcatggtctggtgggaaagttttgtgtgctatgcgatggggtcgcgtcctatcagcttgttggtggggtgatggcctaccaaggcttcgacgggtagccggcctaagagggcgaccggccacattgggactgagatacggcccagactcctacgggaggcagcagtggggaatattgcacaatggggggaaccctgatgcagcgacgccgcgtgcgggatggaggccttcgggttgtgaaccgcttttattggggagcaagctggccctgtgtgggttggtgagtgtacttggtgaataagcaccggctaactacgtgccagcagccgcggtaatacgtagggtgcaagcgttgtccggatttattgggcgtaaagggctcgtaggcggttcgtcgcgtctggtgtgaaagcttactgcttaacggtgggtttgcgttggatacgggcgggcttgagtgcagtaggggagactggaattctcggtgtaacggtggaatgtgtagatatcgggaagaacacctatggcgaaggcaggtctctgggctgttactgacgctgaggagcgaaagcgtggggagcgaacaggattagataccctggtagtccacgctgtaaacggtggacgctggatgtggggcctatttccacgggttctgtgtcggagctaacgcgttaagcgtcccgcctggggagtacggccgcaaggttaaaactcaaagaaattgacgggggcccgcacaagcggcggagcatgcggattaattcgatgcaacgcgaagaaccttaccagggcttgacatgtgagcgttgatcttagagatagggtttcccttcggggcgctttcacaggtggtgcatggtcgtcgtcagctcgtgtcgtgagatgttgggttaagtcccgcaacgagcgcaacccttgccttgtgttgccagcgggtcgtgccggggactcacaagggaccgccggggttaactcggaggaaggtggggatgacgtcagatcatcatgccccttacgtcctgggcttcacgcatgctacaatggctggtacagcgggatgcgatacggtgacgtggagcggatcctgtaaaaccggtctcagttcggatcggagcctgcaactcggctccgtgaaggtggagtcgctagtaatcgcggatcagcagtgccgcggtgaatgcgttcccgggccttgtacacaccgcccgtcaagtcatgaaagtgggcagcacccgaagccggtggcctaacccttgtggggagagccgtctaaggtgaggttcgcgattgggactaagtcgtaacaaggtagccgtaccggaaggtgcggctggatcacctcctttctacgg

SEQ ID NO: 6548 - DNA, 1495 bp, Parasphingopyxis lamellibrachiae
  ref <308>: DATABASE ACCESSION NUMBER: NCBI ACCESSION: NZ_QRDP01000004.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcaggcctaacacatgcaagtcgaacgaagtcttcggacttagtggcgcacgggtgcgtaacgcgtgggaatctacccttaggtgcggaataacagttagaaatgactgctaataccgcataatgactccggtccaaagatttatcgcctaaggatgagcccgcgtaagattagctagttggtgaggtaaaagctcaccaaggcgacgatctttagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctattcaagtcagaggtgaaagcccggggctcaaccccggaactgcctttgaaactagatagctagaatatgggagaggtgagtggaattccgagtgtagaggtgaaattcgtagatattcggaagaacaccagtggcgaaggcgactcactggaccattattgacgctgaggtgcgaaagcgtggggagcaaacaggattagataccctggtagtccacgccgtaaacgatgagaactagctgttggggcccatagggtttcagtggcgcagttaacgcattaagttctccgcctggggagtacggtcgcaagattaaaactcaaaggaattgacgggggcctgcacaagcggtggagcatgtggtttaattcgaagcaacgcgcagaaccttaccagcgtttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccagcatttagttgggcactctaaggaaactgccggtgataagccggaggaaggtggggatgacgtcaagtcctcatggcccttacacgctgggctacacacgtgctacaatggcggtgacagtgggcagctagatcgcaagatcatgctaatctcaaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggtggtgagctaacctgcttgcaggaggcagccaaccacggtcggttcagcgactggggtgaagtcgtaacaaggtagccgtaggggaacctgcggctggatcacctcctttctaag

SEQ ID NO: 6549 - DNA, 1526 bp, Parolsenella catena
  ref <308>: DATABASE ACCESSION NUMBER: NCBI ACCESSION: NZ_AP019367.1
  ref <309>: DATABASE ENTRY DATE: 2019-04-01
  ref <313>: RELEVANT RESIDUES IN SEQ ID NO: (1)..(1526)
ttgaacggagagttcgatcctggctcaggatgaacgctggcggcgcgcctaacacatgcaagtcgaacggttaagacgcacttcggtgcgtgcatagagtggcgaacggctgagtaacacgtgggcaacctgccccccgcaccgggatagcctcgcgaaagcgtgattaataccgggtactccggcacctccgcatggcggtgccgggagagcgttagcggcgggggatgggcccgcggcctgttagctagttggcggggcaacggcccaccaaggcgattatgggtagccgggttgagagaccgaccggccagattgggactgagacacggcccagactcctacgggaggcagcagtggggaatcttgcgcaatggggggaaccctgacgcagcgacgccgcgtgcgggacgaaggccctagggtcgtaaaccgctttcagcagggaagaggccgcgaggtgacggtacctgcagaagaagccccggctaaatacgtgccagcagccgcggtaatacgtatggggcgagcgttatccggattcattgggcgtaaagcgcgcgtaggcggcctggcaggccgggagtcaaatccgggggctcaacccccgcccgctcccggaacctccgggcttgagtctggcaggggagggtggaatacccggtgtagcggtggaatgcgcagatatcgggtagaacaccggtggcgaaggcggccctctgggccacgactgacgctgaggcgcgaaagctgggggagcgaacaggattagataccctggtagtcccagccgtaaacgatggacgctaggtgtggggggacgatccccccgtgccgcagccaacgcactaagcgtcccgcctggggagtacggccgcaaggctaaaactcaaaggaattgacgggggcccgcacaagcagcggagcatgtggcttaattcgaagcaacgcgaagaaccttacctgggcttgacattcaggtgaagcggcggagacgccgtggccgagaggagcctgaacaggtggtgcatggctgtcgtcagctcgtgtcgtgagatgttgggttaagtcccgcaacgagcgcaacccccgccgcgtgttgccagcaggtcatgctgggcacccgcgcgggaccgccggcgtcaagccggaggagggtggggacgacgtcaagtcatcatgccccttatgtccagggctgcacacgtgctacaatggccggcacaacgggctgcgaacccgcgagggcgagcgaatcccttaaagccggccccagttcggaccgggggctgcaacccgcccccgcgaagtcggagttgctagtaatcgcggatcagcacgccgcggtgaatgcgttcccgggccttgtacacaccgcccgtcacaccacccgagtcgtctgcacccgaagtcgccggcccaaccgaggggggggaggcgccgaaggtgtggagggtaaggggggtgaagtcgtaacaaggtagccgtacgggaacgtgcggctggatcacctcctttctagggag

SEQ ID NO: 6550 - DNA, 1417 bp, Parvibacter caecicola
  ref <308>: DATABASE ACCESSION NUMBER: NCBI ACCESSION: NZ_QIBY01000040.1
  ref <309>: DATABASE ENTRY DATE: 2019-04-01
  ref <313>: RELEVANT RESIDUES IN SEQ ID NO: (1)..(1417)
ttcgaacggagagtttgatcctggctcaggatgaacgctggcggcgtgcttaacacatgcaagtcgaacgattaaaccgccctcgggcggaaatagagtggcgaacgggtgagtaacacgtgaccaacctgccccgcgctccgggacaaccgctggaaacggcggctaataccggatactccggccagcccgcatgggccggccgggaaagccttcacggcgcgggatggggtcgcggcccattaggtagtaggcggggtaacggcccacctagcccgcgatgggtagccggactgagaggtcgaccggccacattgggactgagatacggcccagactcctacgggaggcagcagtggggaattttgcgcaatgggggaaaccctgacgcagcaacgccgcgtgcgggacgacggccctcgggttgtaaaccgctttcagtggggacgatggtgacggtacccacagaagaagctccggctaactacgtgccagcagccgcggtaatacgtagggagcgagcgttatccggattcattgggcgtaaagcgcgcgtaggcggctgcctaagcggaacctctaatcccggggctcaacctcgggccgggttccgaactgggcggctcgagtgcggtagaggcaggcggaattcccggtgtagcggtggaatgcgcagatatcgggaagaacaccgatggcgaaggcagcctgctgggccgtcactgacgctgaggcgcgaaagctgggggagcgaacaggattagataccctggtagtcccagccgtaaacgatgggcgctaggtgtggggggaccatccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcgagtgaagccggggaaacccggtggccgagaggagctcgcgcaggtggtgcatggctgtcgtcagctcgtgtcgtgagatgttgggttaagtcccgcaacgagcgcaacccctgtcccgtgttgccagcattcagttggggactcgcgggagactgccggcgttaagccggaggaaggtggggacgacgtcaagtcatcatgccccttatgccctgggctgcacacgtgctacaatggccggtacagagggctgcgacgccgcgaggcggagcgaatcccaaaaagccggccccagttcggatcgcaggctgcaacccgcctgcgtgaagtcggagttgctagtaatcgcggatcagcatgccgcggtgaatacgttcccgggccttgtacacaccgcccgtcacaccacccgagtcgtctgcacccgaagccgccggccgaacccg

SEQ ID NO: 6551 - DNA, 1496 bp, Parvibaculum lavamentivorans
  ref <308>: DATABASE ACCESSION NUMBER: NCBI ACCESSION: NC_009719.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgccctcttcggagggagtggcagacgggtgagtaacacgtgggaacctacctaggggtacggaataactcggggaaactcgtgctaataccgtatacgaccttcgggtgaaagatttatcgcccctagatgggcccgcgctggattagctagttggtggggtaaaagcctaccaaggcgacgatccatagctggtctgagaggatgatcagccacactgggactgagacacggcccagactcctacgggaggcagcagtggggaatcttggacaatgggggaaaccctgatccagccatgccgcgtgagtgatgaaggccttagggttgtaaagctctttcgccagggaagataatgacggtacctggataagaagccccggctaactccgtgccagcagccgcggtaatacggagggggctagcgttgttcggaattactgggcgtaaagcgcacgtaggcggctatccaagttgggggtgaaatccctgggcttaacccaggaactgccttcaaaactggatggctagagtccgagagaggtgagtggaatttccagtgtagaggtgaaattcgtagatattggaaagaacaccagtggcgaaggcggctcactggctcggtactgacgctgaggtgcgacagcgtggggagcaaacaggattagataccctggtagtccacgccgtaaacgatgggtgctagttgtcaggcagcttgctgcttggtgacgcagctaacgcattaagcaccccgcctggggagtacggtcgcaagattaaaactcaaaggaattgacgggggcccgcacaagcggtggagcatgtggtttaattcgaagcaacgcgcagaaccttaccaacccttgacatcccggtcgcggttaccagagatggtttccttcagttcggctggaccggagacaggtgttgcatggctgtcgtcagctcgtgtcgtgagatgttgggttaagtcccgcaacgagcgcaaccctcgcctttagttgccatcattaagttgggcactctagagggactgccgatgataagtcggaggaaggtggggatgacgtcaagtcctcatggcccttacgggttgggctacacacgtgctacaatggcggcgacaatgggcagcgaaggggcgacccggtgcaaatcccaaaaagccgtctcagttcggattgtactctgcaactcgagtgcatgaaggtggaatcgctagtaatcgcgtaacagcatgacgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccctaggggaacctggggctggatcacctcctttctaaggaag

SEQ ID NO: 6552 - DNA, 1530 bp, Parvimonas micra
  ref <308>: DATABASE ACCESSION NUMBER: NCBI ACCESSION: NZ_LR134472.1
  ref <309>: DATABASE ENTRY DATE: 2019-04-01
  ref <313>: RELEVANT RESIDUES IN SEQ ID NO: (1)..(1530)
tttaaatagagagtttgatcctggctcaggacgaacgctggcggcgtgcttaacacatgcaagtcgaacgtgatttttgtggaaattctttcgggaatggaaatgaaatgaaagtggcgaacgggtgagtaacacgtgagcaacctaccttacacagggggatagccgttggaaacgacgattaataccgcatgagaccacagaatcgcatgatataggggtcaaagatttatcggtgtaagaagggctcgcgtctgattagctagttggaagggtaaaggcctaccaaggcgacgatcagtagccggtctgagaggatgaacggccacattggaactgagacacggtccaaactcctacgggaggcagcagtggggaatattgcacaatggggggaaccctgatgcagcgacgccgcgtgagcgaagaaggttttcgaatcgtaaagctctgtcctatgagaagataatgacggtatcataggaggaagccccggctaaatacgtgccagcagccgcggtaatacgtatggggcgagcgttgtccggaattattgggcgtaaagggtacgtaggcggttttttaagtcaggtgtgaaagcgtgaggcttaacctcattaagcacttgaaactggaagacttgagtgaaggagaggaaagtggaattcctagtgtagcggtgaaatgcgtagatattaggaggaataccggtggcgaaggcgactttctggacttttactgacgctcaggtacgaaagcgtggggagcaaacaggattagataccctggtagtccacgccgtaaacgatgaatgctaggtgttgggagtcaaatctcggtgccgaagttaacacattaagcattccgcctggggagtacggtggcaacactgaaactcaaaggaattgacggggacccgcacaagcagcggagcatgtggtttaattcgaagcaacgcgaagaaccttaccaaggcttgacatatagttgagttattgagaaattgataagtccctcgggacaactatacaggtggtgcatggttgtcgtcagctcgtgtcgtgagatgttgggttaagtcccgcaacgagcgcaacccttatcttcagttgccagcacgtagaggtgggaactctggagagactgccgatgacaaatcggaggaaggtggggatgacgtcaaatcatcatgccctttatgtcttgggctacacacgtgctacaatggttggtacaacgagaagcgagatagagatgttaagcgaaactctaaaaaccaatctcagttcggattgtaggctgcaactcgcctacatgaagtcggagttgctagtaatcgcgaatcagaatgtcgcggtgaatgcgttcccgggtcttgtacacaccgcccgtcacaccatgggagttggcaatacccgaagccgccgatctaaccgcaaggaggaaggcgtcgaaggtagggttaatgactggggtgaagtcgtaacaaggtagccgtatcggaaggtgcggctggatcacctcctttct

SEQ ID NO: 6553 - DNA, 1465 bp, Parvularcula bermudensis
  ref <308>: DATABASE ACCESSION NUMBER: NCBI ACCESSION: NC_014414.1
  ref <309>: DATABASE ENTRY DATE: 2019-04-01
  ref <313>: RELEVANT RESIDUES IN SEQ ID NO: (1)..(1465)
caagttgagagtttgatcctggctcaggacgaacgctggcggcaggcttaacacatgcaagtcgaacgatccttcgggatagtggcagacgggtgcgtaacacgtgggaacctacctcagggtacggaataactcggggaaactcgtgctaataccgtatatgcctttgggtgaaagatttatcgccctgagatgggcccgcggctgattaggtagttggtggggtaaaagcctaccaagccgacgatcagtagctggtctgagaggatgatcagccacactgggactgagacacggcccagactcctacgggaggcagcagtgaggaatattggacaatgggggcaaccctgatccagccatgccgcgtgagtgatgaaggccttagggttgtaaaactctttcgccggtgaagataatgacggtaaccggtaaagaagccccggctaatttcgtgccagcagccgcggtaatacgaaaggggctagcgttgttcggaattactgggcgtaaagcgcgcgtaggcgggatgccaagttgggggtgaaatcccggagctcaactccggaactgcctccaaaactggcaacctagaggatgtgagaggatagtggaattccgagtgtagaggtgaaattcgtagatattcggaagaacaccggtggcgaaggcgactgtctggcacatttctgacgctgaggtgcgaaagcgtggggagcaaacaggattagataccctggtagtccacgccgtaaacgatgagggctagttgtcggcttgcatgcaagtcggtgacgcagctaacgcattaagccctccgcctggggagtacggtcgcaagattaaaactcaaaggaattgacgggggcccgcacaagcggtggagcatgtggtttaattcgaagcaacgcgaagaaccttaccaacccttgacatcccgattgcggtttccagagatggataccttcatttagttggatcggtgacaggtgttgcatggctgtcgtcagctcgtgtcgtgagatgttgggttaagtcccgcaacgagcgcaaccctcgctgttagttgccagcatttagttgggcactctaacgggaccgccggtgataagccggaggaaggtggggacgacgtcaagtcatcatggcccttacgggttgggctacacacgtgctacaatggcgctcatagtgggataatccccaaaaggcgtctcagttcggattgtcttctgcaactcgaaggcatgaagtcggaatcgctagtaatcgcggatcagcatgccgcggtgaatacgttcccgggccttgtacacaccgcccgtcacaccatgggagttggttttacccgacgacgctgcgctaaccttcgggaggcaggcggccacggtaagatcagcgactggggtgaagtcgtaacaaggtagccgtaggggaacctgcggctggatcacctcctttctaa

SEQ ID NO: 6554 - DNA, 1467 bp, Parvularcula oceani
  ref <308>: DATABASE ACCESSION NUMBER: NCBI ACCESSION: NZ_JPHU01000026.1
  ref <309>: DATABASE ENTRY DATE: 2019-04-01
  ref <313>: RELEVANT RESIDUES IN SEQ ID NO: (1)..(1467)
aatttgagagtttgatcctggctcaggacgaacgctggcggcaggcttaacacatgcaagtcgaacgagctcttcggagcgagtggcagacgggtgcgtaacacgtgggaacctaccttaaggtacggaataacatcgagaaatcgttgctaataccgtatgtgcccttcgggggaaagatttatcgccttaagatgggcccgcggcggattagctagttggtggggtaaaagcctaccaaggcgacgatccgtagctggtctgagaggatgatcagccacactgggactgagacacggcccagactcctacgggaggcagcagtggggaatattgggcaatgggcgaaagcctgacccagccatgccgcgtgagtgatgaaggccttagggttgtaaaactctttcgccggtgaagataatgacggtaaccggtaaagaagccccggctaatttcgtgccagcagccgcggtaatacgaaaggggctagcgttgttcggaattactgggcgtaaagcgcgcgtaggcggcatgccaagttgggggtgaaatcccggggctcaaccccggaactgcctccaaaactggcaagctagaggatgtgagaggatagtggaattccgagtgtagaggtgaaattcgtagatattcggaagaacaccagtggcgaaggcgactgtctggcacatttctgacgctgaggtgcgaaagcgtggggagcaaacaggattagataccctggtagtccacgccgtaaacgatgagggctagttgtcggcgcgcatgcgtgtcggtgacgcagttaacgcattaagccctccgcctggggagtacggtcgcaagattaaaactcaaaggaattgacgggggcccgcacaagcggtggagcatgtggtttaattcgaagcaacgcgaagaaccttaccagcccttgacatcctggtcgcgggatccagagacggatcctttcatttagttggaccagtgacaggtgttgcatggctgtcgtcagctcgtgtcgtgagatgttgggttaagtcccgcaacgagcgcaaccctcgctgccagttgccagcattcagttgggcactctggcgggaccgccggtgataagccggaggaaggtggggacgacgtcaagtcatcatggcccttacgggctgggctacacacgtgctacaatggcatctatagtgggataatccccaaaagatgtctcagttcggattgtcttctgcaactcgaaggcatgaagtcggaatcgctagtaatcgcggatcagcatgccgcggtgaatacgttcccgggccttgtacacaccgcccgtcacaccatgggagttggttctacccgacgacgctgcgctaaccttttgggggcaggcggccacggtaggatcagcgactggggtgaagtcgtaacaaggtagccgtaggggaacctgcggctggatcacctcctttctaa

SEQ ID NO: 6555 - DNA, 1464 bp, Parvularcula sp. SM1705
  ref <308>: DATABASE ACCESSION NUMBER: NCBI ACCESSION: NZ_QUQO01000001.1
  ref <309>: DATABASE ENTRY DATE: 2019-04-01
  ref <313>: RELEVANT RESIDUES IN SEQ ID NO: (1)..(1464)
caatttgagagtttgatcctggctcaggacgaacgctggcggcaggcttaacacatgcaagtcgaacgaactcttcggagttagtggcagacgggtgcgtaacacgtgggaacctaccctaaggtacggaataactcagggaaacttgtgctaataccgtatatgtcttcggatgaaagatttatcgccttaggatgggcccgcggctgattagtttgttggtggggtaaaagcctaccaagactacgatcagtagctggtctgagaggatgatcagccacactggaactgagacacggtccagactcctacgggaggcagcagtgaggaatattggacaatgggggcaaccctgatccagccatgccgcgtgagtgatgaaggccttagggttgtaaaactctttcgctagtgaagataatgacggtaactagtaaagaagccccggctaatttcgtgccagcagccgcggtaatacgaaaggggcaagcgttgttcggaattactgggcgtaaagcgcgcgtaggcgggacgtcaagttgggggtgaaatcccagggctcaaccctggaactgcctccaaaactgacgacctagaggatgtgagaggatagtggaattccgagtgtagaggtgaaattcgtagatattcggaagaacaccagtggcgaaggcgactgtctggcacatttctgacgctgaggtgcgaaagcgtggggagcaaacaggattagataccctggtagtccacgccgtaaacgatgagggctagttgtcagcaagcatgcttgttggtgacgcagctaacgcattaagccctccgcctggggagtacggtcgcaagattaaaactcaaaggaattgacgggggcccgcacaagcggtggagcatgtggtttaattcgaagcaacgcgaagaaccttaccaacccttgacatcccgatcgcggtttccagagatggattccttcatttagttggatcggtgacaggtgttgcatggctgtcgtcagctcgtgtcgtgagatgttgggttaagtcccgcaacgagcgcaaccctcgctgttagttgccatcatttagttgggcactctaacgggaccgccggtgataagccggaggaaggtggggacgacgtcaagtcatcatggcccttacgggttgggctacacacgtgctacaatggcatctatagtgggataatccctaaaagatgtctcagttcggattgtcttctgcaactcgaaggcatgaagtcggaatcgctagtaatcgcggatcagcatgccgcggtgaatacgttcccgggccttgtacacaccgcccgtcacaccatgggagttggttttacccgacgacgctgtgctaacttcggaggcaggcggccacggtaagatcagcgactggggtgaagtcgtaacaaggtagccgtaggggaacctgcggctggatcacctcctttcta

SEQ ID NO: 6556 - DNA, 1532 bp, Paucibacter sp. KBW04
  ref <308>: DATABASE ACCESSION NUMBER: NCBI ACCESSION: NZ_QAJN01000022.1
  ref <309>: DATABASE ENTRY DATE: 2019-04-01
  ref <313>: RELEVANT RESIDUES IN SEQ ID NO: (1)..(1532)
agatcgaactgtagagtttgatcctggctcagattgaacgctggcggcatgccttacacatgcaagtcgaacggtaacaggttaagctgacgagtggcgaacgggtgagtaatatatcggaacgtgcccagttgtgggggataactactcgaaagagtggctaataccgcatgagacctgagggtgaaagcgggggatcgcaagacctcgcgcaattggagcggccgatatcagattagctagttggcggggtaaaagcccaccaaggcgacgatctgtagctggtctgagaggacgaccagccacactgggactgagacacggcccagactcctacgggaggcagcagtggggaattttggacaatggacgcaagtctgatccagccatgccgcgtgcgggaagaaggccttcgggttgtaaaccgcttttgtcagggaagaaacgggtttctctaatacagagacctaatgacggtacctgaagaataagcaccggctaactacgtgccagcagccgcggtaatacgtagggtgcaagcgttaatcggaattactgggcgtaaagcgtgcgcaggcggttatgcaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggagggtttcttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatggacagaatcctgaagagatttgggagtgctcgaaagagaactgtcacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccggtacagagggctgccaacccgcgagggggagctaatcccagaaaaccggtcgtagtccggatcgtagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttcta

SEQ ID NO: 6557 - DNA, 1473 bp, Paucisalibacillus globulus
  ref <308>: DATABASE ACCESSION NUMBER: NCBI ACCESSION: NZ_LT855389.1
  ref <309>: DATABASE ENTRY DATE: 2019-04-01
  ref <313>: RELEVANT RESIDUES IN SEQ ID NO: (1)..(1473)
tttttggagagtttgatcttggctcaggacgaacgctggcggcgtgcctaatacatgcaagtcgagcgagtgaaactaactgaacccttcggggtgatgttagtggatctagcggcggacgggtgagtaacacgtgggcaacctacctacaagattgggataactccgggaaaccggggctaataccggatgatatttttcttcgcatgaagagaaaatgaaaggcggcgtaagctgtcacttgtagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgatgaaggtcttcggattgtaaagctctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacacccctagagatagggctttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaacctttt

SEQ ID NO: 6558 - DNA, 1567 bp, Paucisalibacillus sp. EB02
  ref <308>: DATABASE ACCESSION NUMBER: NCBI ACCESSION: NZ_CBYO010000020.1
  ref <309>: DATABASE ENTRY DATE: 2019-04-01
  ref <313>: RELEVANT RESIDUES IN SEQ ID NO: (1)..(1567)
ttttttggagagtttgatcttggctcaggacgaacgctggcggcgtgcctaatacatgcaagtcgagcgagtgaaactaactgatcccttcggggtgatgttagtggatctagcggcggacgggtgagtaacacgtgggcaacctgcctatgagactgggataactcgcggaaacgcgagctaataccggataatacttttcatcacatggtgagaaaatgaaaggcggcgtaagctgtcactcatagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgatgaaggtcttcggattgtaaagctctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggcttaaccgtggagggtcattggaaactgggggacttgagtacagaagaggagagtggaattccacgtgtagcggtgaaatgcgtagagatgtggaggaacaccagtggcgaaggcgactctctggtctgtaactgacgctgaggcgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacacccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggatcaatgattggggtgaagtcgtaacaaggtagccgtatcggaaggtgcggctggatcacctcctttctaa

SEQ ID NO: 6559 - DNA, 1550 bp, Pectobacterium aquaticum
  ref <308>: DATABASE ACCESSION NUMBER: NCBI ACCESSION: NZ_QHJS02000052.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagagggggaccttagggcctctcgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataaccttatcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacagaatttggtagagataccttagtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaagaag

SEQ ID NO: 6560 - DNA, 1767 bp, Pectobacterium atrosepticum
  ref <308>: DATABASE ACCESSION NUMBER: NCBI ACCESSION: NZ_AODV01000001.1
  ref <309>: DATABASE ENTRY DATE: 2019-04-01
  ref <313>: RELEVANT RESIDUES IN SEQ ID NO: (1)..(1767)
aaattgaagagtttgatcatggctcagattgaacgctggcggcaggcctaacacatgcaagtcgagcggtagcacagaagagcttgctctttgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcagtaaggttaataaccttgctgattgacgtttgggcgcaagcctgatgcagccatgccgcgtgtgtgaagaaggccttcgggttgtaaagcactttcagcggggaggaaggcagtaaggttaataaccttgctgattgacgttacccgcagaagaagcaccggctaactccgtgccagcagccgcggtaatacggagggtgcaagcgttaatcggaatgactgggcgtaaagcgcacgcaggcggtcccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttggcagagatgccttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagccagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaataaaga

SEQ ID NO: 6561 - DNA, 1551 bp, Pectobacterium carotovorum
  ref <308>: DATABASE ACCESSION NUMBER: NCBI ACCESSION: NZ_OANO01000047.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacctcgcaagagcaaagagggggaccttcgggcctctcgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtaaggttaataaccttatcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagtaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaaaaaga

SEQ ID NO: 6562 - DNA, 1552 bp, Pectobacterium parmentieri
  ref <308>: DATABASE ACCESSION NUMBER: NCBI ACCESSION: NZ_CP027260.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggtagcacagaagagcttgctcttcgggtgacgagcggcggacgggtgagtaatgtctgggaaactgcctgatggagggggataactactggaaacggtagctaataccgcataacgtcttcggaccaaagagggggaccttcgggcctcttgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaattcggtagagataccttagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaaaaaga

SEQ ID NO: 6563 - DNA, 1545 bp, Pectobacterium peruviense
  ref <308>: DATABASE ACCESSION NUMBER: NCBI ACCESSION: NZ_PYUP01000023.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgagcggtagcacagaagagcttgctcttcgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcagtaaggttaataaccttgctgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 6564 - DNA, 1544 bp, Pectobacterium polaris
  ref <308>: DATABASE ACCESSION NUMBER: NCBI ACCESSION: NZ_RRYS01000046.1
  ref <309>: DATABASE ENTRY DATE: 2019-04-01
  ref <313>: RELEVANT RESIDUES IN SEQ ID NO: (1)..(1544)
aaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacctcgcaagagcaaagagggggaccttcgggcctctcgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagtaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 6565 - DNA, 1551 bp, Pectobacterium punjabense
  ref <308>: DATABASE ACCESSION NUMBER: NCBI ACCESSION: NZ_PYSO01000069.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggtagcacaggggagcttgctccctgggtgacgagcggcggacgggtgagtaatgtctgggaaactgcctgatggagggggataactactggaaacggtagctaataccgcataacgtcttcggaccaaagagggggaccttcgggcctcttgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgagattaatactctcatcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaagaag

SEQ ID NO: 6566 - DNA, 454 bp, Pectobacterium zantedeschiae
  ref <308>: DATABASE ACCESSION NUMBER: NCBI ACCESSION: NZ_PESL01000003.1
  ref <309>: DATABASE ENTRY DATE: 2019-04-01
  ref <313>: RELEVANT RESIDUES IN SEQ ID NO: (1)..(454)
aaattgaagagtttgatcatggctcagattgaacgctggcggcaggcctaacacatgcaagtcgaacggtagcacagaagagcttgctcttcgggtgacgagtggcggacgggtgagtaatgtctgggaaactgcctgatggagggggataactactggaaacggtagctaataccgcataacgtcttcggaccaaagagggggaccttcgggcctcttgccatcggatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagg

SEQ ID NO: 6567 - DNA, 1585 bp, Pediococcus argentinicus
  ref <308>: DATABASE ACCESSION NUMBER: NCBI ACCESSION: NZ_JQCQ01000064.1
  ref <309>: DATABASE ENTRY DATE: 2019-04-01
  ref <313>: RELEVANT RESIDUES IN SEQ ID NO: (1)..(1585)
taatatgagagtttgatcttggctcaggatgaacgctggcggcgtgcctaatacatgcaagtcgaacgcacttccgtcgaatgatttcaaggtgcttgcaccgcgaatgaaaatgacatgaagtgagtggcgaacgggtgagtaacacgtgggtaacctgcccagaagtaggggataacacctggaaacagatgctaataccgtataatagagaaaaccgcatggttttcttttgaaagatggctctgctatcacttctggatggacccgcggcgtattagctagttggtgaggtaacggctcaccaaggcagtgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtttcttaagtctaatgtgaaagccttcggctcaaccgaagaagtgcattggaaactgggaaacttgagtgcagaagaggatagtggaactccatgtgtagcggtgaaatgcgtagatatatggaagaacaccagtggcgaaggcggctatctggtctgcaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgccaatctaagagattagacgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaaaccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaa

SEQ ID NO: 6568 - DNA, 1586 bp, Pediococcus cellicola
  ref <308>: DATABASE ACCESSION NUMBER: NCBI ACCESSION: NZ_JQBR01000021.1
  ref <309>: DATABASE ENTRY DATE: 2019-04-01
  ref <313>: RELEVANT RESIDUES IN SEQ ID NO: (1)..(1586)
ataatatgagagtttgatcttggctcaggatgaacgctggcggcgtgcctaatacatgcaagtcggacgcactttcgttaaatgaattagagatgcttgcatcgaagatgattttaaccataaagtgagtggcgaacgggtgagtaacacgtgggtaacctgcccagaagcgggggataacacctggaaacagatgctaataccgcataataacgaaaaccgcatggttttcgtttaaaagatggcttcggctatcacttctggatggacccgcggcgtattagctagttggtgagataatggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgatgaaggctttcgggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggtcttttaagtctaatgtgaaagccttcggcttaaccgaagaagtgcattggaaactgagagacttgagtgcagaagaggagagtggaactccatgtgtagcggtgaaatgcgtagatatatggaagaacaccagtggcgaaggcggctctctggtctgcaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattattagttgccagcattaagttgggcactctagtgagactgccggtgacaaaccggaggaaggtggggacgacgtcaaatcatcatgccccttatgacctgggctacacacgtgctacaatggacggtacaacgagttgcgagaccgcgaggttaagctaatctcttaaaaccgttctcagttcggactgcaggctgcaactcgcctgcacgaagttggaatcgctagtaatcgcggatcagcatgccgcggtgaatacgttcccgggccttgtacacaccgcccgtcacaccatgagagtttgtaacacccaaagccggtggagtaaccttcgggagctagccgtctaaggtgggacagatgattggggtgaagtcgtaacaaggtagccgtaggagaacctgcggctggatcacctcctttctaagga

SEQ ID NO: 6569 - DNA, 1588 bp, Pediococcus claussenii
  ref <308>: DATABASE ACCESSION NUMBER: NCBI ACCESSION: NZ_CP014936.1
  ref <309>: DATABASE ENTRY DATE: 2019-04-01
  ref <313>: RELEVANT RESIDUES IN SEQ ID NO: (1)..(1588)
ataatatgagagtttgatcttggctcaggatgaacgctggcggcgtgcctaatacatgcaagtcgaacgcatttccgttaaaagaatcagaagtgcttgcacggaagatgattttaacaatgaaatgagtggcgaacgggtgagtaacacgtgggtaacctgcccagaagagggggataacacttggaaacaggtgctaataccgcataataaagaaaaccgcatggttttcctttaaaagatggtttcggctatcacttctggatggacccgcggcgtattagctagttggtaaggtaaaggcttaccaaggcagtgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaaactctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatgtggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaagaattgacgggggcccgcacaagcggtggagcatgtggtttaattcgaagctacgcgaagaaccttaccaggtcttgacatcttctgacattctaagagattagaagttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggatggtacaacgagtcgcgaaaccgcgaggtttagctaatctcttaaagccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaa

SEQ ID NO: 6570 - DNA, 1545 bp, Pediococcus damnosus
  ref <308>: DATABASE ACCESSION NUMBER: NCBI ACCESSION: NZ_MRAF01000001.1
  ref <309>: DATABASE ENTRY DATE: 2019-04-01
  ref <313>: RELEVANT RESIDUES IN SEQ ID NO: (1)..(1545)
ggcgtgcctaatacatgcaagtcggacgcactttcgttgattgaattagagatgcttgcatcgaagatgatttcaactataaagtgagtggcgaacgggtgagtaacacgtgggtaacctgcccagaagtgggggataacacctggaaacagatgctaataccgcataataaaatgaaccgcatggtttatttttaaaagatggcttcggctatcacttctggatggacccgcggcgtattagctagttggtgagataaaggctcaccaaggctgtgatacgtagccgacctgagagggtaatcggccacattgggactgagacacggcccagactcctacgggaggcagcagtagggaatcttccacaatggacgaaagtctgatggagcaacgccgcgtgagtgatgaaggctttagggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggttttttaagtctaatgtgaaagccttcggcttaaccgaagaagtgcattggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgctaacctaagagattaggcgttcccttcggggacagaatgacaggtggtgcatggttgtcgtcagctcgtgtcgtgagatgttgggttaagtcccgcaacgagcgcaacccctattattagttgccagcattaagttgggcactctagtgagactgccggtgacaaaccggaggaaggtggggacgacgtcaaatcatcatgccccttatgacctgggctacacacgtgctacaatggacggtacaacgagttgcgagaccgcgaggttaagctaatctcttaaaaccgttctcagttcggactgcaggctgcaactcgcctgcacgaagttggaatcgctagtaatcgcggatcagcatgccgcggtgaatacgttcccgggccttgtacacaccgcccgtcacaccatgagagtttgtaacacccaaagccggtggagtaaccttcgggagctagccgtctaaggtgggacagatgattggggtgaagtcgtaacaaggtagccgtaggagaacctgcggctggatcacctcctttctaagga

SEQ ID NO: 6571 - DNA, 208 bp, Pediococcus ethanolidurans
  ref <308>: DATABASE ACCESSION NUMBER: NCBI ACCESSION: NZ_FOGK01000032.1
  ref <309>: DATABASE ENTRY DATE: 2019-04-01
  ref <313>: RELEVANT RESIDUES IN SEQ ID NO: (1)..(208)
ataatatgagagtttgatcttggctcaggatgaacgctggcggcgtgcctaatacatgcaagtcgaacgcactttcgttaattgattttgagatgcttgcatcgaagatgattttaactataaagtgagtggcgaacgggtgagtaacacgtgggtaacctgcccagaagtgggggataacacctggaaacagatgctaataccgcat

SEQ ID NO: 6572 - DNA, 1585 bp, Pediococcus inopinatus
  ref <308>: DATABASE ACCESSION NUMBER: NCBI ACCESSION: NZ_CP019981.1
  ref <309>: DATABASE ENTRY DATE: 2019-04-01
  ref <313>: RELEVANT RESIDUES IN SEQ ID NO: (1)..(1585)
taatatgagagtttgatcttggctcaggatgaacgctggcggcgtgcctaatacatgcaagtcggacgcactttcgttgaatgatttagagatgcttgcatcgaagatgattttaactataaagtgagtggcgaacgggtgagtaacacgtgggtaacctgcccagaagtgggggataacacctggaaacagatgctaataccgcataataaagtaaaccgcatggttttcttttaaaagatggcttcggctatcacttctggatggacccgcggcgtattagctagttggtgagataaaggcccaccaaggctgtgatacgtagccgacctgagagggtaatcggccacattgggactgagacacggcccagactcctacgggaggcagcagtagggaatcttccacaatggacgaaagtctgatggagcaacgccgcgtgagtgatgaaggctttagggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggtttcttaagtctaatgtgaaagccttcggcttaaccgaagaagtgcattggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgctaacctaagagattaggcgttcccttcggggacagaatgacaggtggtgcatggttgtcgtcagctcgtgtcgtgagatgttgggttaagtcccgcaacgagcgcaacccctattattagttgccagcattaagttgggcactctagtgagactgccggtgataaaccggaggaaggtggggacgacgtcaaatcatcatgccccttatgacctgggctacacacgtgctacaatggacggtacaacgagttgcgagaccgcgaggttaagctaatctcttaaaaccgttctcagttcggactgcaggctgcaactcgcctgcacgaagttggaatcgctagtaatcgcggatcagcatgccgcggtgaatacgttcccgggccttgtacacaccgcccgtcacaccatgagagtttgtaacacccaaagccggtggagtaaccttcgggagctagccgtctaaggtgggacagatgattggggtgaagtcgtaacaaggtagccgtaggagaacctgcggctggatcacctcctttctaagga

SEQ ID NO: 6573 - DNA, 1586 bp, Pediococcus parvulus
  ref <308>: DATABASE ACCESSION NUMBER: NCBI ACCESSION: NZ_LXND01000029.1
  ref <309>: DATABASE ENTRY DATE: 2019-04-01
  ref <313>: RELEVANT RESIDUES IN SEQ ID NO: (1)..(1586)
ataatatgagagtttgatcttggctcaggatgaacgctggcggcgtgcctaatacatgcaagtcgaacgcactttcgttgaatgaattagaggtgcttgcaccgaagatgattttagctataaagtgagtggcgaacgggtgagtaacacgtgggtaacctgcccagaagtgggggataacacctggaaacagatgctaataccgcataacaaagtaaaccgcatggtttacttttaaaagatggcttcggctatcacttctggatggacccgcggcgtattagctagttggtgagataaaggctcaccaaggcagtgatacgtagccgacctgagagggtaatcggccacattgggactgagacacggcccagactcctacgggaggcagcagtagggaatcttccacaatggacgaaagtctgatggagcaacgccgcgtgagtgatgaaggctttagggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggtcttttaagtctaatgtgaaagccttcggcttaaccgaagaagtgcattggaaactggaagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgccaatctaagagattagacgttcccttcggggacagaatgacaggtggtgcatggttgtcgtcagctcgtgtcgtgagatgttgggttaagtcccgcaacgagcgcaacccttattattagttgccagcattaagttgggcactctagtgagactgccggtgacaaaccggaggaaggtggggacgacgtcaaatcatcatgccccttatgacctgggctacacacgtgctacaatggacggtacaacgagttgcgagaccgcgaggtttagctaatctcttaaaaccgttctcagttcggactgcaggctgcaactcgcctgcacgaagttggaatcgctagtaatcgcggatcagcatgccgcggtgaatacgttcccgggccttgtacacaccgcccgtcacaccatgagagtttgtaacacccaaagccggtggagtaaccttcgggagctagccgtctaaggtgggacagatgattggggtgaagtcgtaacaaggtagccgtaggagaacctgcggctggatcacctcctttctaagga

SEQ ID NO: 6574 - DNA, 1586 bp, Pediococcus pentosaceus
  ref <308>: DATABASE ACCESSION NUMBER: NCBI ACCESSION: NZ_UGSX01000002.1
  ref <309>: DATABASE ENTRY DATE: 2019-04-01
  ref <313>: RELEVANT RESIDUES IN SEQ ID NO: (1)..(1586)
ttaatatgagagtttgatcttggctcaggatgaacgctggcggcgtgcctaatacatgcaagtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggtaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgacagtctaagagattagaggttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggatggtacaacgagtcgcgagaccgcgaggttaagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaa

SEQ ID NO: 6575 - DNA, 1488 bp, Pediococcus stilesii
  ref <308>: DATABASE ACCESSION NUMBER: NCBI ACCESSION: NZ_JQBX01000041.1
  ref <309>: DATABASE ENTRY DATE: 2019-04-01
  ref <313>: RELEVANT RESIDUES IN SEQ ID NO: (1)..(1488)
ttaatatgagagtttgatcttggctcaggatgaacgctggcggcgtgcctaatacatgcaagtcgaacgaacttccgttaattgattaagcggtacttgtaccaattgagattttaacacgaagtgagtggcgaacgggtgagtaacacgtgggtaacctgcccagaagtaggggataacacctggaaacagatgctaataccgtataatagagaaaaccgcatggttttcttttgaaagatggctctgctatcacttctggatggacccgcggcgcattagctagttggtaaggtaaaggcttaccaaggcagtgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaagaattgacgggggcccgcacaagcggtggagcatgtggtttaattcgaagctacgcgaagaaccttaccaggtcttgacatcttctgacagtctaagagattagaggttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatgatacaacgagtcgcgaaaccgcgaggtttagctaatctcttaaaatcattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaacctttt

SEQ ID NO: 6576 - DNA, 1441 bp, Pedobacter africanus
  ref <308>: DATABASE ACCESSION NUMBER: NCBI ACCESSION: NZ_FWXT01000009.1
  ref <309>: DATABASE ENTRY DATE: 2019-04-01
  ref <313>: RELEVANT RESIDUES IN SEQ ID NO: (1)..(1441)
cttatgaaagtggcgcacgggtgcgtaacgcgtatgcaacctaccttaatcagggggatagcccgaagaaattcggattaacaccgcataaaatcacagtacagcattgtacaatgatcaaatatttataggattaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggagggaactctgaaccagccatgccgcgtgcaggaagacagccctctgggtcgtaaactgcttttattcgggaataaaccttgctacgtgtagcaagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgtgattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaataatcaagagattgattagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcgaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttctgga

SEQ ID NO: 6577 - DNA, 1518 bp, Pedobacter alluvionis
  ref <308>: DATABASE ACCESSION NUMBER: NCBI ACCESSION: NZ_RCCK01000004.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgatagatgagagcttgctcttatcgaaagtggcgcacgggtgcgtaacgcgtatgcaacctaccttaatcagggggatagcccggagaaatccggattaacaccgcataaaaacacaggatagcattatccaatgttcaaatatttataggattgagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctctttacgagtagagagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacggtcgcaagattgaaactcaaaggaattgacgggggcccgcacaagcggaggagcatgtggtttaattcgatgatacgcgaggaaccttacccgggcttgaaagttagtgaatgatttagagatagatcagtccgcaaggacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6578 - DNA, 1250 bp, Pedobacter antarcticus
  ref <308>: DATABASE ACCESSION NUMBER: NCBI ACCESSION: NZ_FONS01000025.1
  ref <309>: DATABASE ENTRY DATE: 2019-04-01
  ref <313>: RELEVANT RESIDUES IN SEQ ID NO: (1)..(1250)
tggagagtttgatcctggctcaggatgaacgctagcggcaggcctaatacatgcaagtcgaacgatattatccagcttgctggataagaaagtggcgcacgggtgcgtaacgcgtatgcaacctaccttaatcagggggatagcccgaagaaattcggattaagaccgcataaaaacacaggatagcattatccaatgttcaaatatttataggattaagatgggcatgcgtgacattagttagttggcggggtaacggcccaccaagaccacgatgtctaggggatctgagaggatgaccccccacactggtactgagacacggaccagactcctacgggaggcagcagtaaggaatattggtcaatggagggaactctgaaccagccatgccgcgtgcaggatgacggccctctgggttgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatgaactagaggtaggcggaatgtgacaagtagcggtgaaatgcatagatatgtcacagaacaccgattgcgaaggcagcttactatggtttaattgacgctgaggcacgaaagcgtggggatcaaacaggattagataccctggtagtccacgccctaaacgatgaatactcgctgttagcgatacacagttagcggctaagcgaaagcgttaagtattccacctggggagtacggtcgcaagattgaaactcaaaggaattgacgggggcccgcacaagcggaggagcatgtggtttaattcgatgatacgcgaggaaccttacccgggcttgaaagttagtgaatcatttagagatagatgagtccgcaaggacacgaaactaggtgctgcatggctgtcgtcagctcgtgccgtgaggtgttgggttaagtcccgcaacgagcgcaacccctatgtttagttgccagcacgtcatggtggggactctaaacagactgcctgtgcaaacagagaggaaggaggggacgacgtcaagtcatcatggcccttacgtccggggctacacacgtgctacaatgggtggtacagagggcagcaagctgg

SEQ ID NO: 6579 - DNA, 1523 bp, Pedobacter arcticus
  ref <308>: DATABASE ACCESSION NUMBER: NCBI ACCESSION: NZ_AKZJ01000016.1
  ref <309>: DATABASE ENTRY DATE: 2019-04-01
  ref <313>: RELEVANT RESIDUES IN SEQ ID NO: (1)..(1523)
tacaatggagagtttgatcctggctcaggatgaacgctagcggcaggcctaatacatgcaagtcgaacgggattatccagcttgctggatatgagagtggcgtacgggtgcgtaacgcgtatgcaacctaccttgatcagggggatagcccggagaaatccggattaacaccgcataaaaacacagcacagcattgtgcaatgttcaaatattcataggatcaagatgggcatgcgtgccattagctagttggtagggtaacggcctaccaaggcgacgatggctaggggatctgagaggatggccccccacactggtactgagacacggaccagactcctacgggaggcagcagtaaggaatattggtcaatggaggcaactctgaaccagccatgccgcgtgcaggaagacagccctatgggtcgtaaactgcttttatacgggaacaaacctttcttcgtgaagagagctgagcgtaccgtaagaataaggatcggctaactccgtgccagcagccgcggtaatacggaggatccaagcgttatccggatttattgggtttaaagggagcgtaggcggcccgttaagtcaggggtgaaagacggtggctcaaccatcgcagtgcctttgatactgacaggcttgaatacacttgaggtaggcggaatgtgacaagtagcggtgaaatgcatagatatgtcacagaacaccgattgcgaaggcagcttactaaagtgtgattgacgctgaggctcgaaagcgtggggatcaaacaggattagataccctggtagtccacgccctaaacgatgataactcgatgttggcgatatacagtcagcgtccaagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttactgaaggtactagagatagtaccgtccttcgggacaggaaactaggtgctgcatggctgtcgtcagctcgtgccgtgaggtgttgggttaagtcccgcaacgagcgcaacccctatgtttagttgccagcatgtcaagatggggactctaaacagactgcctacgtaagtagagaggaaggtggggacgacgtcaagtcatcatggcccttacgtccggggctacacacgtgctacaatggacggtacagagggcagctacctggcaacaggatgcaaatctcacaaagccgttcacagttcggatcggggtctgcaactcgaccccgtgaagttggattcgctagtaatcgcgtatcagcaatgacgcggtgaatacgttcccgggccttgtacacaccgcccgtcaagccatggaagtcgggggcgcctaaagtccgtaaccgcaaggagcggcctagggtgaaactgataactagggctaagtcgtaacaaggtagccgtaccggaaggtgcggctggaatacctccttt

SEQ ID NO: 6580 - DNA, 1526 bp, Pedobacter borealis
  ref <308>: DATABASE ACCESSION NUMBER: NCBI ACCESSION: NZ_JAUG01000180.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatattaaggggcttgctccttaagaaagtggcgcacgggtgcgtaacgcgtatgcaacctaccttaatcagggggatagcccggagaaatccggattaataccgcataaaatcacaggattgcataatccaatgatcaaacatttatgggattgagatgggcatgcgtgtcattagctggttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctatctacgtgtagatagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtggatcatttagagataaatgagtgagcaatcacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6581 - DNA, 1518 bp, Pedobacter chitinilyticus
  ref <308>: DATABASE ACCESSION NUMBER: NCBI ACCESSION: NZ_SAYW01000003.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaggggtatgggagagcttgctttccctgagaccggcgcacgggtgcgtaacgcgtatgcaacctacccttttctgggggatagcccgaagaaattcggattaataccgcataagaccacgacacggcatcgtgacggggtcaaacatttatgggagaaggatgggcatgcgtgccattagctagttggcggggtaacggcccaccaaggctacgatggctaggggatctgagaggatggccccccacactggtactgagacacggaccagactcctacgggaggcagcagtaaggaatattggtcaatgggcgcaagcctgaaccagccatgccgcgtgcaggaagacggccctccgggttgtaaactgcttttgtacgggaataaacctttcttcgtgaaggaagctgaatgtaccgtaagaataaggatcggctaactccgtgccagcagccgcggtaatacggaggatccaagcgttatccggatttattgggtttaaagggtgcgtaggcggcctgttaagtcaggggtgaaagacggtggctcaaccatcgcagtgcccttgatactgatgggcttgaatggactagaggtaggcggaatgtgacaagtagcggtgaaatgcatagatatgtcacagaacaccgattgcgaaggcagcttactatggtcctattgacgctgaggcacgaaagcgtggggatcgaacaggattagataccctggtagtccacgccctaaacgatgaacactcgctgttggcgatacacggtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaagtatccagagatggatgcgtccttcgggacacgaaactaggtgctgcatggctgtcgtcagctcgtgccgtgaggtgttgggttaagtcccgcaacgagcgcaacccctatgtctagttgccagcatgtaatggtggggactctagacagactgcctgtgcaaacagagaggaaggaggggacgacgtcaagtcatcatggcccttacgtccggggctacacacgtgctacaatggacggtacagagggcagctagacagcaatgtcgtgccaatctcaaaaagccgttcacagttcggatcggggtctgcaactcgaccccgtgaagttggattcgctagtaatcgcgtatcagcaatgacgcggtgaatacgttcccgggccttgtacacaccgcccgtcaagccatggaagttgggggtacctaaagtacgtaaccgcaaggagcgtcctagggtaaaaccgataactggggctaagtcgtaacaaggtagccgtaccggaaggtgcggctggaatacctccttt

SEQ ID NO: 6582 - DNA, 1055 bp, Pedobacter cryoconitis
  ref <308>: DATABASE ACCESSION NUMBER: NCBI ACCESSION: NZ_QLLR01000083.1
  ref <309>: DATABASE ENTRY DATE: 2019-04-01
  ref <313>: RELEVANT RESIDUES IN SEQ ID NO: (1)..(1055)
gctgaatgtaccgaaggaataaggatcggctaactccgtgccagcagccgcggtaatacggaggatccaagcgttatccggatttattgggtttaaagggtgcgtaggcggctttttaagtcaggggtgaaagacggtggctcaaccatcgcagtgcccttgatactgaagagcttgaatgaactagaggtaggcggaatgtgacaagtagcggtgaaatgcatagatatgtcacagaacaccgattgcgaaggcagcttactatggttatattgacgctgaggcacgaaagcgtggggatcaaacaggattagataccctggtagtccacgccctaaacgatgaatactcgctgttagcgatacacagttagcggctaagcgaaagcgttaagtattccacctggggagtacggtcgcaagattgaaactcaaaggaattgacgggggcccgcacaagcggaggagcatgtggtttaattcgatgatacgcgaggaaccttacccgggcttgaaagttagtgaatcatttagagatagatgagtccgcaaggacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagcaagctggtaacagcaagcaaatctccaaaagccattcacagttcggatagaggtctgcaactcgacctcttgaagttggattcgctagtaatcgtatatcagcaatgatacggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6583 - DNA, 1526 bp, Pedobacter ginsenosidimutans
  ref <308>: DATABASE ACCESSION NUMBER: NCBI ACCESSION: NZ_LMZQ01000001.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatattaaggggcttgctccttaagaaagtggcgcacgggtgcgtaacgcgtatgcaacctaccttcatcagggggatagcccggagaaatccggattaataccgcataaaatcacagcactgcatagtgcaatgatcaaacatttatgggatggagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaaccacattacgtgtaatgtgctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatcatttagagataaatgagtgagcaatcacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6584 - DNA, 1519 bp, Pedobacter glucosidilyticus
  ref <308>: DATABASE ACCESSION NUMBER: NCBI ACCESSION: NZ_JMTN01000062.1
  ref <309>: DATABASE ENTRY DATE: 2019-04-01
  ref <313>: RELEVANT RESIDUES IN SEQ ID NO: (1)..(1519)
atggagagtttgatcctggctcaggatgaacgctagcggcaggcctaatacatgcaagtcgaacgggattgaggagcttgcttttcatgagagtggcgaacgggtgcgtaacgcgtatgcaacctaccttcatcagggggatagcccggagaaattcggattaacaccgcataaaaacatagtacggcatcgtacaatgttcaaatattcataggatgaggatgggcatgcgtgtcattagctagttggtaaggtaacggcttaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacggccctatgggttgtaaactgcttttatacgggaataaaccttgattcgtgaatcgagctgaatgtaccgtaagaataaggatcggctaactccgtgccagcagccgcggtaatacggaggatccaagcgttatccggatttattgggtttaaagggagcgtaggcggccatttaagtcagaggtgaaaacttgcagctcaactgtaagcttgcctttgatactgagtggcttgaataaacttgaggtaggcggaatgtgacaagtagcggtgaaatgcatagatatgtcacagaacaccaattgcgaaggcagcttactaaggtttaattgacgctgaggctcgaaagcgtggggatcaaacaggattagataccctggtagtccacgccctaaacgatgataactcgatgttggcgatatacagtcagcgtccaagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaatgaatcagagatgattcagtggtttaccacacgaaactaggtgctgcatggctgtcgtcagctcgtgccgtgaggtgttgggttaagtcccgcaacgagcgcaacccctatgtttagttgccagcatgtaaagatggggactctaaacagactgcctgtgcaaacagagaggaaggatgggacgacgtcaagtcatcatggcccttacgtccggggctacacacgtgctacaatggatggtacagagggcagctacttagcgataagatgccaatctcaaaaagccattcacagttcggatcggggtctgcaactcgaccccgtgaagttggattcgctagtaatcgcgtatcagcaatgacgcggtgaatacgttcccgggccttgtacacaccgcccgtcaagccatggaagttgggggtgcctaaagtccgtaaccgtaaggagcggcctagggtaaaaccgataactggggctaagtcgtaacaaggtagccgtaccggaaggtgcggctggaatacctccttt

SEQ ID NO: 6585 - DNA, 1526 bp, Pedobacter hartonius
  ref <308>: DATABASE ACCESSION NUMBER: NCBI ACCESSION: NZ_FNRA01000030.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatagaagtcagcttgctgacttcaaaagtggcgcacgggtgcgtaacgcgtatgcaacctaccttaatcagggggatagcccgaagaaattcggattaacaccgcataaaatcacagcacagcattgtgtaatgatcaaatatttataggattaagatgggcatgcgtgacattagttagttggcggggtaacggcccaccaagacgacgatgtctaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctcattacgtgtattgagctgaatgtaccgaaggaataaggatcggctaactccgtgccagcagccgcggtaatacggaggatccaagcgttatccggatttattgggtttaaagggtgcgtaggcggctttttaagtcaggggtgaaagacggtagctcaactatcgcagtgcccttgatactgaagagcttgaatggactagaggtaggcggaatgtgacaagtagcggtgaaatgcatagatatgtcacagaacaccgattgcgaaggcagcttactatggttttattgacgctgaggcacgaaagcgtggggatcaaacaggattagataccctggtagtccacgccctaaacgatgaatactcgctgttagcgatacacagttagcggctaagcgaaagcgttaagtattccacctggggagtacggtcgcaagattgaaactcaaaggaattgacgggggcccgcacaagcggaggagcatgtggtttaattcgatgatacgcgaggaaccttacccgggcttgaaagttagtgaatcatttagagatagatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggtaacagcaagcaaatctccaaaagccattcacagttcggatagaggtctgcaactcgacctcttgaagttggattcgctagtaatcgtatatcagcaatgatacggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6586 - DNA, 1526 bp, Pedobacter heparinus
  ref <308>: DATABASE ACCESSION NUMBER: NCBI ACCESSION: NZ_AQGK01000001.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgagattaaggggcttgctccttatgaaagtggcgcacgggtgcgtaacgcgtatgcaacctaccttaatcagggggatagcccgaagaaattcggattaacaccgcataaaaacacaggatagcattatccaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggagggaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgacgggcttgaatacactagaggtaggcggaatgtgacaagtagcggtgaaatgcatagatatgtcacagaacaccgattgcgaaggcagcttactatggtgtgattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaattagatagagatatttaagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcgaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtacgtaaccgcaaggagcgtcctagggtaaaaccgataactggggctaagtcgtaacaaggtagccgtaccggaaggtgcggctggaatacctcctttct

SEQ ID NO: 6587 - DNA, 1518 bp, Pedobacter jejuensis
  ref <308>: DATABASE ACCESSION NUMBER: NCBI ACCESSION: NZ_RBEE01000027.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgatagatagaggcttgcttctatcgaaagtggcgcacgggtgcgtaacgcgtatgcaacctaccttaatcagggggatagcccgaagaaattcggattaacaccgcataaaaacacagagtagcattactcaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctatgggtcgtaaactgcttttatccgggaataaacctttctacgtgtaggaagctgaatgtaccggaagaataaggatcggctaactccgtgccagcagccgcggtaatacggaggatccaagcgttatccggatttattgggtttaaagggtgcgtaggcggcctgttaagtcagaggtgaaagacggtagctcaactatcgcagtgcctttgatactgacgggcttgaataaactagaggtaggcggaatgagacaagtagcggtgaaatgcatagatatgtctcagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgctcgcaagagtgaaactcaaaggaattgacgggggcccgcacaagcggaggagcatgtggtttaattcgatgatacgcgaggaaccttacccgggcttgaaagttagtgaagatttcagagatgaattcgtccgcaaggacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgtaaggagcgtcctagggtaaaaccgataactggggctaagtcgtaacaaggtagccgtaccggaaggtgcggctggaatacctccttt

SEQ ID NO: 6588 - DNA, 1518 bp, Pedobacter jeongneungensis
  ref <308>: DATABASE ACCESSION NUMBER: NCBI ACCESSION: NZ_AYMG01000035.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgatattttccagcttgctggaagagaaagtggcgcacgggtgcgtaacgcgtatgcaacctacctttatcagggggatagcccggagaaatccggattaataccgcataacatcatgttatagcattatagtatgatcaaacatttatgggataaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctacttacgtgtaagtagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcctattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatcatttagagatagatgagtccgcaaggacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctagctggcaacagtatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagctgggggtacctaaagtatgtaaccgcaaggagcgtcctagggtaaaaccggtaactggggctaagtcgtaacaaggtagccgtaccggaaggtgcggctggaatacctccttt

SEQ ID NO: 6589 - DNA, 1521 bp, Pedobacter kyungheensis
  ref <308>: DATABASE ACCESSION NUMBER: NCBI ACCESSION: NZ_JSYN01000008.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacgcgattaaggggcttgctccttatgaaagtggcgcacgggtgcgtaacgcgtatgcaacctacctttatcagggggatagcccggagaaatccggattaacaccgcataaaatcacaggatagcattatccaatgatcaaatatttataggataaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggagggaactctgaaccagccatgccgcgtgcaggaagactgccctatgggttgtaaactgcttttatccgggaataaacctacttacgtgtaagtagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgatttagagatagatcagtgagcaatcacacgaaactaggtgctgcatggctgtcgtcagctcgtgccgtgaggtgttgggttaagtcccgcaacgagcgcaacccctatgtttagttgccagcatgtaatggtggggactctaaacagactgcctgtgcaaacagagaggaaggaggggacgacgtcaagtcatcatggcccttacgtccggggctacacacgtgctacaatggatggtacagagggcagctagctggcaacagtatgcgaatctcacaaagccattcacagttcggattggggtctgcaactcgaccccatgaagttggattcgctagtaatcgcgtatcagcaatgacgcggtgaatacgttcccgtacacagtacacaccgcccgtcaagccatggaagctgggggtacctaaagtatgtaaccgcaaggagcgtcctagggtaaaaccggtaactggggctaagtcgtaacaaggtagccgtaccggaaggtgcggctggaatacctcctttctg

SEQ ID NO: 6590 - DNA, 1518 bp, Pedobacter luteus
  ref <308>: DATABASE ACCESSION NUMBER: NCBI ACCESSION: NZ_FUYR01000009.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgagattgaggagcttgctcttcatgaaagtggcgcacgggtgcgtaacgcgtatgcaacctaccttaatcagggggatagcctctcgaaagagagattaacaccgcataaaatcacaagctggcatcagcaaatgatcaaatatttataggattaagatgggcatgcgtgacattagctagttggtaaggtaacggcttaccaaggctacgatgtctaggggatctgagaggatgaccccccacactggtactgagacacggaccagactcctacgggaggcagcagtaaggaatattggtcaatggaggcaactctgaaccagccatgccgcgtgcaggaagacggccctacgggttgtaaactgcttttatacgggaataaacctctttacgtgtaaagagttgaatgtactgtaagaataaggatcggctaactccgtgccagcagccgcggtaatacggaggatccaagcgttatccggatttattgggtttaaagggtgcgtaggcggcctattaagtcaggggtgaaagacggtggctcaaccatcgcagtgcccttgatactgatgggcttgattacacttgaggtaggcggaatgtgacaagtagcggtgaaatgcatagatatgtcacagaacaccaattgcgaaggcagcttactaaggtgttaatgacgctgaggcacgaaagcgtggggatcaaacaggattagataccctggtagtccacgccctaaacgatgaatactcgatgttagcgatatacagttagcgtcaaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttactgaagtatccagagatggatgcgtccgcaaggacaggaaactaggtgctgcatggctgtcgtcagctcgtgccgtgaggtgttgggttaagtcccgcaacgagcgcaacccctatgtttagttgccagcatgttatggtggggactctaaacagactgcctgtgcaaacagagaggaaggaggggacgacgtcaagtcatcatggcccttacgtccggggctacacacgtgctacaatggatggtacagagggccgctacctggtaacaggatgccaatctcaaaaagccattcacagttcggatagaggtctgcaactcgacctcttgaagttggattcgctagtaatcgcatatcagcaatgatgcggtgaatacgttcccgggccttgtacacaccgcccgtcaagccatggaagttgggggtacctgaagtacgtaaccgcaaggagcgtcctagggtaaaaccgataactggggctaagtcgtaacaaggtagccgtaccggaaggtgcggctggaatacctccttt

SEQ ID NO: 6591 - DNA, 1518 bp, Pedobacter nutrimenti
  ref <308>: DATABASE ACCESSION NUMBER: NCBI ACCESSION: NZ_QKLU01000016.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgagattaagaggcttgcttcttatgaaagtggcgcacgggtgcgtaacgcgtatgcaacctaccttaatcagggggatagcccgaagaaattcggattaagaccgcataaaaacacaggatagcattatccaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggagggaactctgaaccagccatgccgcgtgcaggaagacagccctctgggtcgtaaactgcttttattcgggaataaacctttctacgtgtaggaagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatctagagatagatcagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcgaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgtaaggagcgtcctagggtaaaaccgataactggggctaagtcgtaacaaggtagccgtaccggaaggtgcggctggaatacctccttt

SEQ ID NO: 6592 - DNA, 1526 bp, Pedobacter nyackensis
  ref <308>: DATABASE ACCESSION NUMBER: NCBI ACCESSION: NZ_FWYB01000031.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatactctctggcttgctggagaggaaagtggcgcacgggtgcgtaacgcgtatgcaacctaccttaatcagggggatagcccgaagaaattcggattaacaccgcataaaaacacaggatagcattatccaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgtgattgacgctgaggcacgaaagcgtggggatcaaacaggattagataccctggtagtccacgccctaaacgatgaatactcgctgttagcgatacacagttagcggctaagcgaaagcgttaagtattccacctggggagtacggtcgcaagattgaaactcaaaggaattgacgggggcccgcacaagcggaggagcatgtggtttaattcgatgatacgcgaggaaccttacccgggcttgaaagttagtgaatcatttagagatagatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagctagctggtaacagtatgcgaatctcacaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6593 - DNA, 1526 bp, Pedobacter panaciterrae
  ref <308>: DATABASE ACCESSION NUMBER: NCBI ACCESSION: NZ_LGEL01000156.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatagataccagcttgctggtatcaaaagtggcgcacgggtgcgtaacgcgtatgcaacctacctcaatcagggggatagcccgaagaaattcggattaacaccgcataaaaacacagtacagcattgtacaatgttcaaatatttataggattgagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctgcttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaattatctagagatagataagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6594 - DNA, 1526 bp, Pedobacter sp. BAL39
  ref <308>: DATABASE ACCESSION NUMBER: NCBI ACCESSION: NZ_ABCM01000016.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgatactttccagcttgctggagaggaaagtggcgcacgggtgcgtaacgcgtatgcaacctaccttaatcagggggatagcccgaagaaattcggattaacaccgcataaaatcacagtatagcattatacaatgatcaaatatttataggattaagatgggcatgcgtgtcattagttagttggcggggtaacggcccaccaagacagcgatgactaggggatctgagaggatgaccccccacactggtactgagacacggaccagactcctacgggaggcagcagtaaggaatattggtcaatggaggcaactctgaaccagccatgccgcgtgcaggaagacggccctctgggttgtaaactgcttttattcgggaataaacctccttacgtgtaaggagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacattagaggtaggcggaatgtgacaagtagcggtgaaatgcatagatatgtcacagaacaccgattgcgaaggcagcttactatgatgagattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatcatttagagatagatgagtgcgcaatcacacgaatctaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggagggaggggacgacgtcaagtcatcatggcccttacgtccggggttacacacgtgctacaatggatggtacagagggcagcaagctggcaacagcaagcaaatctcaaaaagccattcacagttaggatagaggtctgcaactcgacctcttgaagttggattcgctagtaatcgcgtatcagcaatgacgcggtgaatacgttcccgggctttgtacacaccgcccgtcaagccatggaagttgggggtacctaaagtatgtaaccgcaaggagcgtcatagggtaaaaccgataaatggggctaagtcgtaacaaggtagccgtaccggaaggtgcggctggaatacctcctttct

SEQ ID NO: 6595 - DNA, 1525 bp, Pedobacter sp. BMA
  ref <308>: DATABASE ACCESSION NUMBER: NCBI ACCESSION: NZ_LECU01000006.1
  ref <309>: DATABASE ENTRY DATE: 2019-04-01
  ref <313>: RELEVANT RESIDUES IN SEQ ID NO: (1)..(1525)
ttacaatggagagtttgatcctggctcaggatgaacgctagcggcaggcctaatacatgcaagtcgaggggtagagagagcttgctttcttgagaccggcgcacgggtgcgtaacgcgtatgcaacctacctttatctgggggatagcccggagaaatccggattaataccgcataaaatcacaggatagcattatctaatgatcaaacatttatgggatgaagatgggcatgcgtgtcattagctagttggcggggtaatggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctttctacgtgtaggaagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgatttagagatagatcagtgagcaatcacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgtaaggagcgtcctagggtaaaaccgataactggggctaagtcgtaacaaggtagccgtaccggaaggtgcggctggaatacctcctttctg

SEQ ID NO: 6596 - DNA, 1521 bp, Pedobacter sp. CF523
  ref <308>: DATABASE ACCESSION NUMBER: NCBI ACCESSION: NZ_REFF01000007.1
  ref <309>: DATABASE ENTRY DATE: 2019-04-01
  ref <313>: RELEVANT RESIDUES IN SEQ ID NO: (1)..(1521)
tacaatggagagtttgatcctggctcaggatgaacgctagcggcaggcctaatacatgcaagtcgaggggtagagaaggcttgctttcttgagaccggcgcacgggtgcgtaacgcgtatgcaacctacctttatctgggggatagcccggagaaatccggattaataccgcataaaatcacagaatagcattatttaatgatcaaacatttatgggatgaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggatgactgccctatgggttgtaaactgcttttatccgggaataaacctacttacgtgtaagtagctgaacgtaccggaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaattatctagagatagataagtgagcaatcacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6597 - DNA, 1519 bp, Pedobacter sp. G11
  ref <308>: DATABASE ACCESSION NUMBER: NCBI ACCESSION: NZ_CP034190.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcgaggggtagaagaggcttgcttctttgagaccggcgcacgggtgcgtaacgcgtatgcaacctaccttcatctgggggatagcccggagaaatccggattaataccgcataaaatcacaggatggcattatccaatgatcaaacatttatgggatggagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttattcgggaataaaccttattacgtgtaataagctgaatgtaccgaaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatgatctagagatagatcagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgaaaggagcgtcctagggtaaaaccgataactggggctaagtcgtaacaaggtagccgtaccggaaggtgcggctggaatacctcctttctg

SEQ ID NO: 6598 - DNA, 1524 bp, Pedobacter sp. HMWF019
  ref <308>: DATABASE ACCESSION NUMBER: NCBI ACCESSION: NZ_QAIL01000243.1
  ref <309>: DATABASE ENTRY DATE: 2019-04-01
  ref <313>: RELEVANT RESIDUES IN SEQ ID NO: (1)..(1524)
ttacaatggagagtttgatcctggctcaggatgaacgctagcggcaggcctaatacatgcaagtcgaacgagattaaggagcttgctctttatgaaagtggcgcacgggtgcgtaacgcgtatgcaacctaccttaatcagggggatagcccgaagaaattcggattaagaccgcataaaaacacaggatagcattatccaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggagggaactctgaaccagccatgccgcgtgcaggaagacagccctctgggtcgtaaactgcttttattcgggaataaaccttattacgtgtaataagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatctagagatagatcagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6599 - DNA, 1516 bp, Pedobacter sp. Hv1
  ref <308>: DATABASE ACCESSION NUMBER: NCBI ACCESSION: NZ_LLWP01000001.1
  ref <309>: DATABASE ENTRY DATE: 2019-04-01
  ref <313>: RELEVANT RESIDUES IN SEQ ID NO: (1)..(1516)
tggagagtttgatcctggctcaggatgaacgctagcggcaggcctaatacatgcaagtcgaggggtagggttagcttgctaacctgagaccggcgcacgggtgcgtaacgcgtatgcaatctacctctatctgggggatagcccggagaaatccggattaacaccgcataaaatcacagtacggcatcgtacaatgatcaaatatttataggatagagatgagcatgcgtgtcattagttagttggcggggtaacggcccaccaagaccacgatgactaggggatctgagaggatgaccccccacactggtactgagacacggaccagactcctacgggaggcagcagtaaggaatattggtcaatggaggcaactctgaaccagccatgccgcgtgcaggaagacggccctctgggttgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgtgacaagtagcggtgaaatgcatagatatgtcacagaacaccgattgcgaaggcagcttactatggtcttattgacgctgaggcacgaaagcgtggggatcaaacaggattagataccctggtagtccacgccctaaacgatgaatactcgctgttggcgatacacagtcagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaagtatccagagatggatgcgtccgcaaggacacgaaactaggtgctgcatggctgtcgtcagctcgtgccgtgaggtgttgggttaagtcccgcaacgagcgcaacccctatgtttagttgccagcacgtaatggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggattggggtctgcaactcgaccccatgaagttggattcgctagtaatcgcatatcagcaatgatgcggtgaatacgttcccgggccttgtacacaccgcccgtcaagccatggaagttgggggtacctaaagtacgtaaccgcaaggagcgtcctagggtaaaaccgataactggggctaagtcgtaacaaggtagccgtaccggaaggtgcggctggaatacctccttt

SEQ ID NO: 6600 - DNA, 1519 bp, Pedobacter sp. KBW01
  ref <308>: DATABASE ACCESSION NUMBER: NCBI ACCESSION: NZ_QAJQ01000043.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcgaacgcgattaaagggcttgctctttatgaaagtggcgcacgggtgcgtaacgcgtatgcaacctacctttatcagggggatagcccggagaaatccggattaacaccgcataaaatcacaggatagcattattcaatgatcaaatatttataggataaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctacttacgtgtaagtagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgatttagagatagatcagtgagcaatcacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagctgggggtacctaaagtatgtaaccgcaaggagcgtcctagggtaaaaccggtaactggggctaagtcgtaacaaggtagccgtaccggaaggtgcggctggaatacctcctttc

SEQ ID NO: 6601 - DNA, 1518 bp, Pedobacter sp. KBW06
  ref <308>: DATABASE ACCESSION NUMBER: NCBI ACCESSION: NZ_QAJL01000008.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgatagtgaagggcttgctcttcacgaaagtggcgcacgggtgcgtaacgcgtatgcaacctaccttaatcagggggatagcccgaagaaattcggattaacaccgcataaaatcacagtacagcattgtacaatgatcaaatatttataggattaagatgggcatgcgtgtcattagttagttggcgaggtaacggctcaccaagaccacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgttattgacgctgaggcacgaaagcgtggggatcaaacaggattagataccctggtagtccacgccctaaacgatgaatactcgctgttagcgatacacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatctagagatagatcagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6602 - DNA, 1521 bp, Pedobacter sp. Leaf176
  ref <308>: DATABASE ACCESSION NUMBER: NCBI ACCESSION: NZ_LMPD01000001.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacgataccaagaggcttgcttcttggaaaagtggcgcacgggtgcgtaacgcgtatgcaacctaccttaatcagggggatagcccgaagaaattcggattaacaccgcataaaaacacagagtagcattactcaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctatgggtcgtaaactgcttttatccgggaataaacctttctacgtgtaggaagctgaatgtactggaagaataaggatcggctaactccgtgccagcagccgcggtaatacggaggatccaagcgttatccggatttattgggtttaaagggtgcgtaggcggcctattaagtcagaggtgaaagacggtagctcaactatcgcagtgcctttgatactgatgggcttgaatgaactagaggtaggcggaatgagacaagtagcggtgaaatgcatagatatgtctcagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgctcgcaagagtgaaactcaaaggaattgacgggggcccgcacaagcggaggagcatgtggtttaattcgatgatacgcgaggaaccttacccgggcttgaaagttagtgaagatttcagagatgaattcgtccgcaaggacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgtaaggagcgtcctagggtaaaaccgataactggggctaagtcgtaacaaggtagccgtaccggaaggtgcggctggaatacctcctttctg

SEQ ID NO: 6603 - DNA, 1531 bp, Pedobacter sp. Leaf194
  ref <308>: DATABASE ACCESSION NUMBER: NCBI ACCESSION: NZ_LMPU01000009.1
  ref <309>: DATABASE ENTRY DATE: 2019-04-01
  ref <313>: RELEVANT RESIDUES IN SEQ ID NO: (1)..(1531)
ttacaatggagagtttgatcctggctcaggatgaacgctagcggcaggcctaatacatgcaagtcgaacgataccaagaggcttgcttcttggaaaagtggcgcacgggtgcgtaacgcgtatgcaacctaccttaatcagggggatagcccgaagaaattcggattaacaccgcataaaaacacagaatagcattattcaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacggccctatgggttgtaaactgcttttatccgggaataaacctttctacgtgtagagagctgaatgtaccggaagaataaggatcggctaactccgtgccagcagccgcggtaatacggaggatccaagcgttatccggatttattgggtttaaagggtgcgtaggcggcctgttaagtcagaggtgaaagacggtagctcaactatcgcagtgcctttgatactgacgggcttgaatgaactagaggtaggcggaatgagacaagtagcggtgaaatgcatagatatgtctcagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgctcgcaagagtgaaactcaaaggaattgacgggggcccgcacaagcggaggagcatgtggtttaattcgatgatacgcgaggaaccttacccgggcttgaaagttagtgaattattcagagatgaataagtgagcaatcacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagagaggaaggaggggacgacgtcaagtcatcatggcccttacgtccggggctacacacgtgctacaatggatggtacagagggcagctagctggcaacagtatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgtaaggagcgtcctagggtaaaaccgataactggggctaagtcgtaacaaggtagccgtaccggaaggtgcggctggaatacctcctttctggagc

SEQ ID NO: 6604 - DNA, 1526 bp, Pedobacter sp. Leaf216
  ref <308>: DATABASE ACCESSION NUMBER: NCBI ACCESSION: NZ_LMKM01000001.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgagattrtccagcttgctggatttgaaagtggcgcacgggtgcgtaacgcgtatgcaacctaccttaatctgggggatagcccggagaaatccggattaataccgcataaaatcacaggatggcattatccaatgatcaaacatttatgggattgagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctttctacgtgtaggaagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcggtacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatcatttagagataaatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggacggtacagagggcagctagccggcaacggtatgcgaatctcacaaagccgttcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6605 - DNA, 1519 bp, Pedobacter sp. Leaf41
  ref <308>: DATABASE ACCESSION NUMBER: NCBI ACCESSION: NZ_LMLE01000009.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcgaggggtagargwkgcttgcwwcyttgagaccggcgcacgggtgcgtaacgcgtatgcaacctaccttcatctgggggatagcccggagaaatccggattaataccgcataaaatcacaggatggcattatccaatgatcaaacatttatgggatggagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttattcgggaataaacctatttacgtgtaaatagctgaatgtaccgaaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatgatccagagatggatcagtgagcaatcacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgaaaggagcgtcctagggtaaaaccgataactggggctaagtcgtaacaaggtagccgtaccggaaggtgcggctggaatacctcctttctg

SEQ ID NO: 6606 - DNA, 1521 bp, Pedobacter sp. OK291
  ref <308>: DATABASE ACCESSION NUMBER: NCBI ACCESSION: NZ_QBKL01000004.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacgatagataagagcttgcttttatcgaaagtggcgcacgggtgcgtaacgcgtatgcaacctaccttcatctgggggatagcccggagaaatccggattaataccgcataaaatcacaggatggcattatccaatgatcaaacatttatgggaagaagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctgcttacgtgtaagtagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatgatttagagatagatcagtgagcaatcacacgaaactaggtgctgcatggctgtcgtcagctcgtgccgtgaggtgttgggttaagtcccgcaacgagcgcaacccctatgtttagttgccagcacgtcaaggtggggactctaaacagactgcctgtgcaaacagagaggaaggaggggacgacgtcaagtcatcatggcccttacgtccggggctacacacgtgctacaatggatggtacagagggcagctagccggcaacggtatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttctg

SEQ ID NO: 6607 - DNA, 1522 bp, Pedobacter sp. OV280
  ref <308>: DATABASE ACCESSION NUMBER: NCBI ACCESSION: NZ_QUNL01000046.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcggcaggcctaatacatgcaagtcgaacgatattaaggggcttgctccttaagaaagtggcgcacgggtgcgtaacgcgtatgcaacctaccttaatctgggggatagcccggagaaatccggattaataccgcataaaatcacagaatggcattattcaatgatcaaacatttatgggattgagatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaaccacattacgtgtagtgtgctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacgctcgcaagagtgaaactcaaaggaattgacgggggcccgcacaagcggaggagcatgtggtttaattcgatgatacgcgaggaaccttacccgggcttgaaagttagtgaatcatttagagatagatgagtgagcaatcacacgaaactaggtgctgcatggctgtcgtcagctcgtgccgtgaggtgttgggttaagtcccgcaacgagcgcaacccctatgtttagttgccagcacgtcaaggtggggactctaaacagactgcctgtgcaaacagagaggaaggaggggacgacgtcaagtcatcatggcccttacgtccggggctacacacgtgctacaatggatggtacagagggcagctagccggcaacggtatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6608 - DNA, 1526 bp, Pedobacter sp. PACM 27299
  ref <308>: DATABASE ACCESSION NUMBER: NCBI ACCESSION: NZ_CP012996.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgataccgagaggcttgcttctcgggaaagtggcgcacgggtgcgtaacgcgtatgcaacctacctcaatcagggggatagcccgaagaaattcggattaacaccgcataaaatcacaggatagcattatccaatgatcaaatatttataggattgagatgggcatgcgtgtcattagttagttggcgaggtaacggctcaccaagaccacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgtcattgacgctgaggcacgaaagcgtggggatcaaacaggattagataccctggtagtccacgccctaaacgatgaatactcgctgttagcgatacacagttagcggctaagcgaaagcgttaagtattccacctggggagtacggtcgcaagattgaaactcaaaggaattgacgggggcccgcacaagcggaggagcatgtggtttaattcgatgatacgcgaggaaccttacccgggcttgaaagttagtgaatcatttagagatagatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6609 - DNA, 1430 bp, Pedobacter sp. R-8
  ref <308>: DATABASE ACCESSION NUMBER: NCBI ACCESSION: NZ_QGNY01000014.1
  ref <309>: DATABASE ENTRY DATE: 2019-04-01
  ref <313>: RELEVANT RESIDUES IN SEQ ID NO: (1)..(1430)
aaagtggcgcacgggtgcgtaacgcgtatgcaacctgcctctgtctgggggatagcccggagaaatccggattaataccgcataaaatcacagtacggcattgtacaatgatcaaacatttatgggacagggatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctgtctacgtgtaggcagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgacgggcttgaatagactagaggtaggcggaatgagacaagtagcggtgaaatgcatagatatgtctcagaacaccgattgcgaaggcagcttactatggtcttattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacggtcgcaagattgaaactcaaaggaattgacgggggcccgcacaagcggaggagcatgtggtttaattcgatgatacgcgaggaaccttacccgggcttgaaagttagtgaagtttccagagatgggaacgtccgcaaggacacgaaactaggtgctgcatggctgtcgtcagctcgtgccgtgaggtgttgggttaagtcccgcaacgagcgcaacccctatgtttagttgccagcacgttatggtggggactctaaacagactgcctgtgcaaacagagaggaaggaggggacgacgtcaagtcatcatggcccttacgtccggggctacacacgtgctacaatggacggtacagagggcagctacacagcaatgtggtgcgaatctcacaaagccgttcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6610 - DNA, 1524 bp, Pedobacter sp. R20-19
  ref <308>: DATABASE ACCESSION NUMBER: NCBI ACCESSION: NZ_JCKI01000008.1
  ref <309>: DATABASE ENTRY DATE: 2019-04-01
  ref <313>: RELEVANT RESIDUES IN SEQ ID NO: (1)..(1524)
ttacaatggagagtttgatcctggctcaggatgaacgctagcggcaggcctaatacatgcaagtcgaggggtagagtaggcttgcttacttgagaccggcgcacgggtgcgtaacgcgtatgcaacctacctttatctgggggatagcccggagaaatccggattaataccgcataaaatcacagaatggcattattcaatgatcaaacattaatgggatagagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaaccacaatacgtgtattgtgctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcctttgatactgatgggcttgaatgaactagaggtaggcggaatgagacaagtagcggtgaaatgcatagatatgtctcagaacaccgattgcgaaggcagcttactatggtttaattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacggtcgcaagattgaaactcaaaggaattgacgggggcccgcacaagcggaggagcatgtggtttaattcgatgatacgcgaggaaccttacccgggcttgaaagttagtgaatcatttagagataaatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagctacatagcaatatgatgcgaatctcacaaagccattcacagttcggattggggtctgcaactcgaccccatgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6611 - DNA, 1518 bp, Pedobacter sp. SYP-B3415
  ref <308>: DATABASE ACCESSION NUMBER: NCBI ACCESSION: NZ_RXNQ01000021.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgagattgaggagcttgctcctcatgaaagtggcgcacgggtgcgtaacgcgtatgcaacctaccttaatcagggggatagcccggagaaatccggattaacaccgcataaaatcacaggatagcattatccaatgatcaaatatttataggattaagatgggcatgcgtgtcattagctagttggcggggtaacggcccaccaaggcgacgatgactaggggctctgagaggagaatcccccacactggtactgagacacggaccagactcctacgggaggcagcagtaaggaatattggtcaatggaggcaactctgaaccagccatgccgcgtgcaggaagactgccctatgggttgtaaactgcttttataccggaataaacctcatttcgtgaaatgagctgaatgtacggtaagaataaggatcggctaactccgtgccagcagccgcggtaatacggaggatccaagcgttatccggatttattgggtttaaagggtgcgtaggcggcctattaagtcaggggtgaaagacggtggctcaaccatcgcagtgcctttgatactgatgggcttgaatgaactagaggtaggcggaatgtgacaagtagcggtgaaatgcatagatatgtcacagaacaccgattgcgaaggcagcttactatggtttaattgacgctgaggcacgaaagcgtggggatcgaacaggattagataccctggtagtccacgccctaaacgatgaacactcgctgttggcgatacacggtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaattattcagagatgaataagtccttcgggacacgaaactaggtgctgcatggctgtcgtcagctcgtgccgtgaggtgttgggttaagtcccgcaacgagcgcaacccctatgtttagttgccagcatgtaatggtggggactctaaacagactgcctgtgcaaacagagaggaaggaggggacgacgtcaagtcatcatggcccttacgtccggggctacacacgtgctacaatggtcagtacagagggcagccagccagcaatggtgcgccaatctcaaaaagctgatcacagttcggattggggtctgcaactcgaccccatgaagttggattcgctagtaatcgcgtatcagcaatgacgcggtgaatacgttcccgggccttgtacacaccgcccgtcaagccatggaagctgggggtacctaaagtatgtaaccgcaaggagcgtcctagggtaaaaccggtaactggggctaagtcgtaacaaggtagccgtaccggaaggtgcggctggaatacctccttt

SEQ ID NO: 6612 - DNA, 1526 bp, Pedobacter sp. V48
  ref <308>: DATABASE ACCESSION NUMBER: NCBI ACCESSION: NZ_AWRU01000031.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacgagattaaggggcttgctccttatgaaagtggcgcacgggtgcgtaacgcgtatgcaacctacctcaatcagggggatagcccgaagaaattcggattaacaccgcataaaaacacaggatagcattatccaatgttcaaatatttataggattgagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaaccttattacgtgtaataagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcctttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaattatctagagatagataagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttct

SEQ ID NO: 6613 - DNA, 1515 bp, Pedobacter sp. YR016
  ref <308>: DATABASE ACCESSION NUMBER: NCBI ACCESSION: NZ_QBKM01000015.1
  ref <309>: DATABASE ENTRY DATE: 2019-04-01
  ref <313>: RELEVANT RESIDUES IN SEQ ID NO: (1)..(1515)
agagtttgatcctggctcaggatgaacgctagcggcaggcctaatacatgcaagtcgaacgatactttccagcttgctggaaaggaaagtggcgcacgggtgcgtaacgcgtatgcaacctacctcaatcagggggatagcccgaagaaattcggattaacaccgcataaaaacacagtacagcattgtacaatgttcaaatatttataggattgagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatcatttagagatagatgagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggtaacagcaagcgaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctccttt

SEQ ID NO: 6614 - DNA, 1519 bp, Pedobacter sp. YR510; identical to SEQ ID NO: 6597
  ref <308>: DATABASE ACCESSION NUMBER: NCBI ACCESSION: NZ_QUNJ01000001.1
  ref <309>: DATABASE ENTRY DATE: 2019-04-01
  ref <313>: RELEVANT RESIDUES IN SEQ ID NO: (1)..(1519)

SEQ ID NO: 6615 - DNA, 1518 bp, Pedobacter sp. eg
  ref <308>: DATABASE ACCESSION NUMBER: NCBI ACCESSION: NZ_LS999839.1
  ref <309>: DATABASE ENTRY DATE: 2019-04-01
  ref <313>: RELEVANT RESIDUES IN SEQ ID NO: (1)..(1518)
tggagagtttgatcctggctcaggatgaacgctagcggcaggcctaatacatgcaagtcgaacgataatatccagcttgctggatatgaaagtggcgcacgggtgcgtaacgcgtatgcaacctaccttaatcagggggatagcccgaagaaattcggattaacaccgcataaaaacacaggatagcattatccaatgttcaaatatttataggattaagatgggcatgcgtgtcattagctagttggcggggtaacggcccaccaaggcgacgatgactaggggatctgagaggatgaccccccacactggtactgagacacggaccagactcctacgggaggcagcagtaaggaatattggtcaatggagggaactctgaaccagccatgccgcgtgcaggaagacggccctctgggttgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgtgattgacgctgaggcacgaaagcgtggggatcaaacaggattagataccctggtagtccacgccctaaacgatgaatactcgctgttagcgatatacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatttagagatagatcagtgagcaatcacacgaaactaggtgctgcatggctgtcgtcagctcgtgccgtgaggtgttgggttaagtcccgcaacgagcgcaacccctatgtttagttgccatcaggtaaagctggggactctaaacagactgcctgtgcaaacagagaggaaggaggggacgacgtcaagtcatcatggcccttacgtccggggctacacacgtgctacaatggatggtacagagggcagctagctggtaacagtatgccaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtacgtaaccgcaaggagcgtcctagggtaaaaccgataactggggctaagtcgtaacaaggtagccgtaccggaaggtgcggctggaatacctccttt

SEQ ID NO: 6616 - DNA, 1530 bp, Pedobacter steynii
  ref <308>: DATABASE ACCESSION NUMBER: NCBI ACCESSION: NZ_FNGY01000028.1
  ref <309>: DATABASE ENTRY DATE: 2019-04-01
  ref <313>: RELEVANT RESIDUES IN SEQ ID NO: (1)..(1530)
ttacaatggagagtttgatcctggctcaggatgaacgctagcggcaggcctaatacatgcaagtcgaacgataccatttagcttgctagatgggaaagtggcgcacgggtgcgtaacgcgtatgcaacctaccttaatcagggggatagcccgaagaaattcggattaacaccgcataaaatcacagtacagcattgtacaatgatcaaatatttataggattaagatgggcatgcgtgtcattagttagttggcgaggtaacggctcaccaagaccacgatgactaggggatctgagaggatgaccccccacactggtactgagacacggaccagactcctacgggaggcagcagtaaggaatattggtcaatggaggcaactctgaaccagccatgccgcgtgcaggaagacagccctctgggtcgtaaactgcttttattcgggaataaacctacttacgtgtaagtagctgaatgtaccgaaggaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgttattgacgctgaggcacgaaagcgtggggatcaaacaggattagataccctggtagtccacgccctaaacgatgaatactcgctgttagcgatacacagttagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaatgatctagagatagatcagtgagcaatcacacgaaactaggtgctgcatggctgtcgtcagctcgtgccgtgaggtgttgggttaagtcccgcaacgagcgcaacccctatgtttagttgccagcacgttaaggtggggactctaaacagactgcctgtgcaaacagagaggaaggaggggacgacgtcaagtcatcatggcccttacgtccggggctacacacgtgctacaatggatggtacagagggcagcaagctggcaacagcaagcaaatctcaaaaagccattcacagttcggatagaggtctgcaactcgacctcttgaagttggattcgctagtaatcgcgtatcagcaatgacgcggtgaatacgttcccgggccttgtacacaccgcccgtcaagccatggaagttgggggtacctaaagtatgtaaccgcaaggagcgtcctagggtaaaaccgataactggggctaagtcgtaacaaggtagccgtaccggaaggtgcggctggaatacctcctttctggag

SEQ ID NO: 6617 - DNA, 1522 bp, Pedobacter tournemirensis
  ref <308>: DATABASE ACCESSION NUMBER: NCBI ACCESSION: NZ_RXOC01000024.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcggcaggcctaatacatgcaagtcgaacgagattgaagagcttgctcttcatgaaagtggcgcacgggtgcgtaacgcgtatgcaatctgccttactcagggggatagcccggagaaatccggattaacaccgcataacatcatgatatggcatcatattatgatcaaatatttataggagtaagatgagcatgcgtgacattagctagttggtaaggtaacggcttaccaaggcgacgatgtctaggggatctgagaggatgaccccccacactggtactgagacacggaccagactcctacgggaggcagcagtaaggaatattggtcaatggaggcaactctgaaccagccatgccgcgtgcaggaagacggccctacgggttgtaaactgcttttgtacgggaataaacccctttatgtataaagggctgaatgtactgtaagaataaggatcggctaactccgtgccagcagccgcggtaatacggaggatccaagcgttatccggatttattgggtttaaagggtgcgtaggcggcttattaagtcaggggtgaaagacggtggctcaaccatcgcagtgcctttgatactgatgagcttgaatctacctgaggtaggcggaatgtgacaagtagcggtgaaatgcatagatatgtcacagaacaccaattgcgaaggcagcttactaaagtggtattgacgctgaggcacgaaagcgtggggatcaaacaggattagataccctggtagtccacgccctaaacgatgaacactcgatgttggcgatatacagtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttactgaatgactcagagatgagtcagtccttcgggacaggaaactaggtgctgcatggctgtcgtcagctcgtgccgtgaggtgttgggttaagtcccgcaacgagcgcaacccctgtgaatagttgccagcatgtaaaggtggggactctattcagactgcctgtgcaaacagagaggaaggcggggacgacgtcaagtcatcatggcccttacgtccggggctacacacgtgctacaatggatggtacagagggcagctacgtagtaatacgatgccaatctcaaaaagccattcacagttcggattgaggtctgcaactcgacctcatgaagttggattcgctagtaatcgcagatcagcaatgctgcggtgaatacgttcccgggccttgtacacaccgcccgtcaagccatggaagctgggggtacctgaagtatgtaaccgcaaggagcgtcctagggtaaaaccggtaactggggctaagtcgtaacaaggtagccgtaccggaaggtgcggctggaatacctccttt

SEQ ID NO: 6618 - DNA, 1523 bp, Pedobacter xixiisoli
  ref <308>: DATABASE ACCESSION NUMBER: NCBI ACCESSION: NZ_OCMT01000006.1
  ref <309>: DATABASE ENTRY DATE: 2019-04-01
  ref <313>: RELEVANT RESIDUES IN SEQ ID NO: (1)..(1523)
tacaatggagagtttgatcctggctcaggatgaacgctagcggcaggcctaatacatgcaagtcgaggggtagggctagcttgctggcctgagaccggcgcacgggtgcgtaacgcgtatgcaacctacccttttctgggggatagcccgaagaaattcggattaataccgcataagaccacgatacggcatcgtgatgtggtcaaacatttatgggagaaggatgggcatgcgtgccattagctagttggcggggtaacggcccaccaaggcgacgatggctaggggatctgagaggatggccccccacactggtactgagacacggaccagactcctacgggaggcagcagtaaggaatattggtcaatggaggcaactctgaaccagccatgccgcgtgcaggaagacggccctctgggttgtaaactgcttttatccgggaataaacctatctacgtgtagatagctgaatgtaccggaggaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgtgacaagtagcggtgaaatgcatagatatgtcacagaacaccgattgcgaaggcagcttactatggtcctattgacgctgaggcacgaaagcgtggggatcaaacaggattagataccctggtagtccacgccctaaacgatgaatactcgctgttggcgatacacagtcagcggctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttagtgaactatccagagatggatgggtccttcgggacacgaaactaggtgctgcatggctgtcgtcagctcgtgccgtgaggtgttgggttaagtcccgcaacgagcgcaacccctatgtttagttgccagcacgtaatggtggggactctagacagactgcctgtgcaaacagagaggaaggaggggacgacgtcaagtcatcatggcccttacgtccggggctacacacgtgctacaatggacggtacagagggcagctaggcagcaatgtcgtgcgaatctcaaaaagccgttcacagttcggattggggtctgcaactcgaccccatgaagttggattcgctagtaatcgcatatcagcaatgatgcggtgaatacgttcccgggccttgtacacaccgcccgtcaagccatggaagttgggggtacctaaagtacgtaaccgcaaggagcgtcctagggtaaaaccgataactggggctaagtcgtaacaaggtagccgtaccggaaggtgcggctggaatacctcctttct

SEQ ID NO: 6619 - DNA, 1121 bp, Pedobacter yonginense
  ref <308>: DATABASE ACCESSION NUMBER: NCBI ACCESSION: NZ_QGNZ01000009.1
  ref <309>: DATABASE ENTRY DATE: 2019-04-01
  ref <313>: RELEVANT RESIDUES IN SEQ ID NO: (1)..(1121)
tggagagtttgatcctggctcaggatgaacgctagcggcaggcctaatacatgcaagtcgaacgatatcaaggggcttgctccttgagaaagtggcgcacgggtgcgtaacgcgtatgcaacctaccttcatctgggggatagcccggagaaatccggattaataccgcataaaatcacagtacggcattgtacaatgatcaaacattcatgggatgaggatgggcatgcgtgtcattagctagttggcggggtaacggcccaccaaggcgacgatgactaggggatctgagaggatggccccccacactggtactgagacacggaccagactcctacgggaggcagcagtaaggaatattggtcaatggaggcaactctgaaccagccatgccgcgtgcaggaagactgccctatgggttgtaaactgcttttatccgggaataaacctatctacgtgtagatagctgaatgtaccggaagaataaggatcggctaactccgtgccagcagccgcggtaatacggaggatccaagcgttatccggatttattgggtttaaagggtgcgtaggcggcctgttaagtcaggggtgaaagacggtagctcaactatcgcagtgcccttgatactgacgggcttgaatagactagaggtaggcggaatgagacaagtagcggtgaaatgcatagatatgtctcagaacaccgattgcgaaggcagcttactatggtctgattgacgctgaggcacgaaagcgtggggatcaaacaggattagataccctggtagtccacgccctaaacgatgaacactcgctgttggcgatacacagtcagcggctaagcgaaagcgttaagtgttccacctggggagtacggtcgcaagattgaaactcaaaggaattgacgggggcccgcacaagcggaggagcatgtggtttaattcgatgatacgcgaggaaccttacccgggcttgaaagttagtgaaggtagcagagatgctaccgtccgcaaggacacgaaactaggtgctgcatggctgtcgtcagctcgtgccgtgaggtgttgggttaagtcccgcaacgagcgcaacccctatgtttagttgccagcacgtca

SEQ ID NO: 6620 - DNA, 1525 bp, Pedobacter yulinensis
  ref <308>: DATABASE ACCESSION NUMBER: NCBI ACCESSION: NZ_KZ686275.1
  ref <309>: DATABASE ENTRY DATE: 2019-04-01
  ref <313>: RELEVANT RESIDUES IN SEQ ID NO: (1)..(1525)
tacaatggagagtttgatcctggctcaggatgaacgctagcggcaggcctaatacatgcaagtcgaacgagattgaggagcttgctcctcatgaaagtggcgcacgggtgcgtaacgcgtatgcaacctaccttaatcagggggatagcccggagaaatccggattaacaccgcataaaatcacaataccgcatggtataatgatcaaatatttataggattaagatgggcatgcgtgtcattagctagttggcggggtaacggcccaccaaggcgacgatgactaggggctctgagaggagaatcccccacactggtactgagacacggaccagactcctacgggaggcagcagtaaggaatattggtcaatggaggcaactctgaaccagccatgccgcgtgcaggaagactgccctatgggttgtaaactgcttttataccggaataaacctctttacgtgtaaggagctgaatgtacggtaagaataaggatcggctaactccgtgccagcagccgcggtaatacggaggatccaagcgttatccggatttattgggtttaaagggtgcgtaggcggcctattaagtcaggggtgaaagacggtggctcaaccatcgcagtgcctttgatactgataggcttgaatgaactagaggtaggcggaatgtgacaagtagcggtgaaatgcatagatatgtcacagaacaccgattgcgaaggcagcttactatggtttaattgacgctgaggcacgaaagcgtggggatcgaacaggattagataccctggtagtccacgccctaaacgatgaacactcgctgttggcgatacacggtcagcggctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaattattcagagatgaataagtccttcgggacacgaaactaggtgctgcatggctgtcgtcagctcgtgccgtgaggtgttgggttaagtcccgcaacgagcgcaacccctatgtttagttgccagcatgtaatggtggggactctaaacagactgcctgtgcaaacagagaggaaggaggggacgacgtcaagtcatcatggcccttacgtccggggctacacacgtgctacaatggtcagtacagagggcagccagccagcaatggtgcgccaatctcaaaaagctgatcacagttcggattggggtctgcaactcgaccccatgaagttggattcgctagtaatcgcgtatcagcaatgacgcggtgaatacgttcccgggccttgtacacaccgcccgtcaagccatggaagctgggggtacctaaagtatgtaaccgcaaggagcgtcctagggtaaaaccggtaactggggctaagtcgtaacaaggtagccgtaccggaaggtgcggctggaatacctcctttct

SEQ ID NO: 6621 - DNA, 1579 bp, Pedosphaera parvula
  ref <308>: DATABASE ACCESSION NUMBER: NCBI ACCESSION: NZ_ABOX02000035.1
  ref <309>: DATABASE ENTRY DATE: 2019-04-01
  ref <313>: RELEVANT RESIDUES IN SEQ ID NO: (1)..(1579)
taacggagagtttgattctggctcagaacgaacgctggcggcgtggataagacatgcaagtcgaacgctaatcaaattgtagcaatacagtttggttggagtggcgcaagggtgcgtaacacgtgggtaatttgccatagagttggggataactcgctgaaaggcgagctaataccgaatgtgatcattggggggcatcccctggtgatcaaagctggggaccgcaaggcctggcgctctatgataagcccgcggcctatcagctagttggtgaggtaacggctcaccaaggctaagacgggtagctggtctgagaggacgaccagccacactggaactgagacacggtccagacacctacgggtggcagcagtcgagaatttttctcaatgggcgcaagcctgaaggagcgacgccgcgtgggggatgaatggcttcggcccgtaaacccctgtcatttgcgaacaaaccttacggttgaacagatcgtgagctgattgtagcggaagaggaagggacggctaactctgtgccagcagccgcggtaatacagaggtcccaagcgttgttcggattcactgggcgtaaagggtgcgtaggtggcagggtaagtttgatgtgaaatctccgagcttaactcggaaactgcattgaatactatcctgcttgagggttggaggggagactggaattctcggtgtagcagtgaaatgcgtagatatcgagaggaacaccagtggcgaaggcgagtctctggacaactcctgacactgaggcacgaaagctaggggagcaaacaggattagataccctggtagtcctagccgtaaacggtgcatatttgctgtaaaaggaatcgaccccttttgtggcgtagccaacgcgttaaatatgccgcctgggaagtacggtcgcaagattaaaactcaaagaaattgacgggggcctgcacaagcggtggagtatgtggcttaattcgatgcaacgcgaagaaccttacctggccttgacatgcaagtagtagaaccatgaaagtgggacgaggtagcaataccagcttgcacaggtgctgcatggctgtcgtcagctcgtgtcgtgagatgttgggttaagtcccgcaacgagcgcaacccctatgtcctgttgccacccgaacgagagtttggagcactctggacagactgcctcgcttaaacgaggaggaaggtggggatgacgtcaagtcagtatggcccttacggccagggctgcacacgtactacaatgcctggtacaaagggaagcaagactgtaaagtggagcaaatcccccaaaaccaggcccagttcagattgtcgtctgcaactcgacggcatgaagctggaatcgctagtaatggcgcatcagctacggcgccgtgaatacgttcccaggccttgtacacaccgcccgtcacatcatgaaagccggttgtacccgaagtcaatgtgttaaccgcaaggagacagttgccgaaggtatggctggtgattgggatgaagtcgtaacaaggtagccgtaggggaacctgcggctggatcacctcctttctaaggagaaa

SEQ ID NO: 6622 - DNA, 1469 bp, Pelagibaca abyssi
  ref <308>: DATABASE ACCESSION NUMBER: NCBI ACCESSION: NZ_CP015093.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgccctcttcggagggagcggcggacgggttagtaacgcgtgggaacgtgcccttctctgcggaatagccactggaaacggtgagtaataccgcatacgcccttcgggggaaagatttatcggagaaggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcagctacatccagagatggatggttcccttcggggactgagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtgtctacagtgggttaatccccaaaagacatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttacagggggcagcggaccacggtgagctcagcgactggggtgaagtcgtaacaaggtagccgtaggggaacctgcggctggatcacctcctttctaa

SEQ ID NO: 6623 - DNA, 1486 bp, Pelagibacteraceae bacterium ETNP-OMZ-SAG-E5
  ref <308>: DATABASE ACCESSION NUMBER: NCBI ACCESSION: NZ_MDKK01000001.1
  ref <309>: DATABASE ENTRY DATE: 2019-04-01
  ref <313>: RELEVANT RESIDUES IN SEQ ID NO: (1)..(1486)
attaaacttgagagtttgatcatggctcagaacgtacgctggcggcacgcttaacacatgcaagtcgaacgaagtagcaatacttagtggcagacgggtgagtataatgtgggaatctgccttttggttcagaataactcggggaaacttgagctaatactggataagccctcacggggaaagctttatgcgccaagagatgaacccgcacttgattagcttgttggtgaggtaaaagctcaccaaggcaacgatcaatagctgttcttagaggaagaccagccacattgggactgagacacggcccagactcctacgggaggcagcagtggggaatcttgcacaatgggggaaaccctgatgcagcgatgccgcgtgagtgaagaaggcctttgggttgtaaaactctttcgtcggggaagaaaatgactgtacccgaataagaaggtccggctaacttcgtgccagcagccgcggtaatacgaagggacctagcgtagttcggaattactgggcttaaagagctcgtaggtggttaaagaagttggtggtgaaatcccaaggcttaaccttggaactgccatcaaaactttttagctagagtatgatagaggaaagtggaatttctagtgtagaggtgaaattcgtagatattagaaagaacaccaaaagcgaaggcaactttctggatcattactgacactgaggagcgaaagcatgggtagcgaagaggattagataccctcgtagtccatgctgtaaacgatgtgtgctagacgttggaaatttaattttcagtgtcgcagcaaaagcattaagcacaccgcctggggagtacgaccgcaaggttaaaactcaaatgaattgacggggacccgcacaagcagtggagcatgtggtttaattcgaagatacgcgcagaaccttaccaactcttgacatgttcgtcgcgactcgtagagatatgagtcttcggttcggccggacgaaacacaggtgctgcatggctgtcgtcagctcgtgtcgtgagatgttgggttaagtcccgcaacgagcgcaacccctacgtttagttactaacatttagttgagtactctaaacgaactgccagtgataagctggaggaaggtggggatgacgtcaagtcctcatggcccttacgagttgggctacacacgtgctacaatggtacttacaataagatgcaaagaggcaactctaagccaatcttaaaaatgtatctcagttcggattgcactctgcaactcgagtgcatgaagctggaattgctagtaatcgcggatcagcgcgccgcggtgaatacgttcccgggtcttgtacacaccgcccgtcacaccatggaagttggttacaccttaaggcaaagcgtaaaacctttgactacggtacgatcagcgactggggtgaagtcgtaacaaggtagccgtaggggaacctgcggctggatcacctcctttctaagga

SEQ ID NO: 6624 - DNA, 1492 bp, Pelagibacterium halotolerans
  ref <308>: DATABASE ACCESSION NUMBER: NCBI ACCESSION: NC_016078.1
  ref <309>: DATABASE ENTRY DATE: 2019-04-01
  ref <313>: RELEVANT RESIDUES IN SEQ ID NO: (1)..(1492)
aacttgagagtttgatcctggctcagaacgaacgctggcggcaggcttaacacatgcaagtcgaacgaagtcttcggacttagtggcagacgggtgagtaacgcgtgggaatctacccagttctctggaataactgatggaaacgtcagctaataccggatacgcccttttggggaaagatttatcgggattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccggagctcaactccggaactgcctttgatactggatatctagagaccgagagaggtaagtggaactcctagtgtagaggtggaattcgtagatattaggaagaacaccagtggcgaaggcggcttactggctcggaactgacgctgaggtgcgaaagcgtggggagcaaacaggattagataccctggtagtccacgccgtaaactatgagagctagccgttggggtgtttacacttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcgctttccagagatggattgcttcagttcggctggaccggtgacaggtgctgcatggctgtcgtcagctcgtgtcgtgagatgttgggttaagtcccgcaacgagcgcaaccctcgcctttagttgccatcatttggttgggcactctagagggactgccggtgataagccggaggaaggtggggatgaggtcaagtcatcatggcccttacgggctgggctacacacgtgctacaatggtggtgacagagggcagctaggccgcgaggtcatgctaatcccaaaaaaccatctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccttttggaggcagccgaccacggtagggtcagcgactggggtgaagtcgtaacaaggtagccgtaggggaacctgcggctggatcacctcctttctaagga

SEQ ID NO: 6625 - DNA, 1490 bp, Pelagibacterium lentulum
  ref <308>: DATABASE ACCESSION NUMBER: NCBI ACCESSION: NZ_RZMW01000022.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgaacgaagtcttcggacttagtggcagacgggtgagtaacgcgtgggaacctacctggtactacggaatagctccgggaaactggaattaataccgtatacgcccttttggggaaagatttatcggtatcagatgggcccgcgtaagattagctagttggtggggtaatggcccaccaaggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggaattactgggcgtaaagcgcacgtaggcggatatttaagtcaggggtgaaatcccggagctcaactccggaactgcctttgatactggatatctagagaccgagagaggtaagtggaactcctagtgtagaggtggaattcgtagatattaggaagaacaccagtggcgaaggcggcttactggctcggaactgacgctgaggtgcgaaagcgtggggagcaaacaggattagataccctggtagtccacgccgtaaacgatgagagctagtcgttggggagtttactcttcagtgacgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcgctttccagagatggattgcttcagttcggctggaccggtgacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgaggtcaagtcatcatggcccttacgggctgggctacacacgtgctacaatggtggtgacagagggcagctacacagcgatgtgatgctaatccctaaaaaccatctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgtaaggaggcagccgaccacggtagggtcagcgactggggtgaagtcgtaacaaggtagccgtaggggaacctgcggctggatcacctcctttctaag

SEQ ID NO: 6626 - DNA, 1490 bp, Pelagibacterium montanilacus
  ref <308>: DATABASE ACCESSION NUMBER: NCBI ACCESSION: NZ_RZMX01000011.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgaggacttcggtcctagcggcagacgggtgagtaacgcgtgggaatctacccagtcctgcggaatagctccgggaaactggaattaataccgcatacgcccttttggggaaagatttatcgggattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcagaggtgaaatcccagggctcaaccctggaactgcctttgatactgggtatcttgaggccgagagaggtgagtggaactcctagtgtagaggtggaattcgtagatattaggaagaacaccagtggcgaaggcggctcactggctcggtactgacgctgaggtgcgaaagcgtggggagcaaacaggattagataccctggtagtccacgccgtaaacgatggaagctagccgttggggggtttacccttcagtggcgcagctaacgcattaagcttcccgcctggggagtacggtcgcaagattaaaactcaaaggaattgacgggggcccgcacaagcggtggagcatgtggtttaattcgaagcaacgcgaagaaccttaccagcccttgacatcccggtcgcgctttccagagatggattgcttcagttcggctggaccggtgacaggtgctgcatggctgtcgtcagctcgtgtcgtgagatgttgggttaagtcccgcaacgagcgcaaccctcgcctttagttgccatcatttggttgggcactctagagggactgccggtgataagccggaggaaggtggggatgaggtcaagtcatcatggcccttacgggctgggctacacacgtgctacaatggcggtgacagagggcagctaggtcgcgaggccgtgctaatccctaaaagccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaggcagccgaccacggtagggtcagcgactggggtgaagtcgtaacaaggtagccgtaggggaacctgcggctggatcacctcctttctaag

SEQ ID NO: 6627 - DNA, 1488 bp, Pelagibacterium sp. IMCC34151
  ref <308>: DATABASE ACCESSION NUMBER: NCBI ACCESSION: NZ_QMEL01000020.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgaacgatcccttcggggatagtggcagacgggtgagtaacacgtgggaatctacctggttcttcgggataacagttggaaacgactgctaataccggatacgcccttttggggaaagatttatcggaatcggatgagcccgcgtaagattagctagatggtggggtaatggcccaccatggcgacgatctttagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcagtggggaagataatgacggtacccacacaagaagccccggctaacttcgtgccagcagccgcggtaatacgaagggggctagcgttgttcggatttactgggcgtaaagcgcacgtaggcggattggtcagttaggggtgaaatcccggagctcaactccggaactgcctttaatactgccagtctagagtccgagagaggtgagtggaactcctagtgtagaggtggaattcgtagatattaggaagaacaccagtggcgaaggcggctcactggctcggtactgacgctgaggtgcgaaagcgtggggagcaaacaggattagataccctggtagtccacgccgtaaactatgagagctagccgttggggtgtttacacttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcgctttccagagatggattgcttcagttcggctggaccggtgacaggtgctgcatggctgtcgtcagctcgtgtcgtgagatgttgggttaagtcccgcaacgagcgcaaccctcgcctttagttgccatcatttggttgggcactctagagggactgccggtgataagccggaggaaggtggggatgaggtcaagtcatcatggcccttacgggctgggctacacacgtgctacaatggtggtgacagagggcagctagaccgcgaggtcatgctaatccccaaaagccatctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccttttagggggcagccgaccacggtagggtcagcgactggggtgaagtcgtaacaaggtagccgtaggggaacctgcggctggatcacctcctttct

SEQ ID NO: 6628 - DNA, 1472 bp, Pelagicola litorisediminis
  ref <308>: DATABASE ACCESSION NUMBER: NCBI ACCESSION: NZ_FWFL01000002.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgcaccttcgggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgaaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggattggaaagtatggggtgaaatcccagggctcaaccctggaactgcctcataaactatcagtctagagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtagtttccagagatggattcgtcagttcggctggacgagatacaggtgctgcatggctgtcgtcagctcgtgtcgtgagatgttcggttaagtccggcaacgagcgcaacccacatccctagttgccagcaggttaagctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaaccttttaggagggggcagcggaccacggtgagctcagcgactggggtgaagtcgtaacaaggtagccgtaggggaacctgcggctggatcacctcctttctaa

SEQ ID NO: 6629 - DNA, 1470 bp, Pelagicola sp. LXJ1103
  ref <308>: DATABASE ACCESSION NUMBER: NCBI ACCESSION: NZ_QFAR01000001.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggttagtaacgcgtgggaacataccctttactaaggaatagccactggaaacggtgagtaataccttatacgcccttcgggggaaagatttatcggtaaaggattggcccgcgttagattagatagttggtggggtaatggcctaccaagtctacgatctatagttgatttgagaggatgatcagcaacactgggactgagacacggcccagactcctacgggaggcagcagtggggaatcttagacaatgggcgcaagcctgatctagccatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgtacgtaggcggattagaaagtatggggtgaaatcccagggctcaaccctggaactgcctcataaacttctagtctagagttcgagagaggtgagtagaattccgagtgtagaggtgaaattcgtagatattcggaggaataccagtggcgaaggcggctcactggctcgatactgacgctgaggtacgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcatcatactttagagagatctatcggtcagttcggctggatgagatacaggtgctgcatggctgtcgtcagctcgtgtcgtgagatgttcggttaagtccggcaacgagcgcaacccacatccctagttgccagcaggttaagctgggcactctatggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 6630 - DNA, 1577 bp, Pelagirhabdus alkalitolerans
  ref <308>: DATABASE ACCESSION NUMBER: NCBI ACCESSION: NZ_FMYI01000018.1
  ref <309>: DATABASE ENTRY DATE: 2019-04-01
  ref <313>: RELEVANT RESIDUES IN SEQ ID NO: (1)..(1577)
attttaatgagagtttgatcttggctcaggacgaacgctggcggcgtgcctaatacatgcaagtcgagcgcgtgaagctaaaccgattccttcgggatgacgtttagtggaacgagcggcggacgggtgagtaacacgtgggcaacctacctataagactgggataactcgtggaaacgcgagctaataccggataatacaaccgacctcctggcaggttgttgaaaggtggctcttttgagctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacaagtaccgttcgaatagggcggtaccttgacggtacctaacgaggaagccccggctaactacgtgccagcagccgcggtaatacgtagggggcaagcgttgtccggaattattgggcgtaaagcgcgcgcaggcggttttttaagtctgatgtgaaatcttgtggctcaaccacaagcggtcattggaaactggagaacttgaggacagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgaacatacgagagatcgtgttttcccttcggggacagagtgacaggtggtgcatggttgtcgtcagctcgtgtcgtgagatgttgggttaagtcccgcaacgagcgcaacccttaatcttagttgccagcatttagttgggcactctaaggtgactgccggtgacaaaccggaggaaggtggggacgacgtcaaatcatcatgccccttatgacctgggctacacacgtgctacaatggatggtacaaagggccgcgaaaccgcgaggtcaagcaaatcccataaaaccattctcagttcggattgcaggctgcaactcgcctgcatgaagccggaatcgctagtaatcgtggatcagcatgccacggtgaatacgttcccgggtcttgtacacaccgcccgtcacaccacgagagttggcaacacccgaagtcggtgaggtaacctttttaggagccaaccgccgaaggtggggctaatgattggggtgaagtcgtaacaaggtagccgtatcggaaggtgcggctggatcacctcctttctaa

SEQ ID NO: 6631 - DNA, 1474 bp, Pelagivirga sediminicola
  ref <308>: DATABASE ACCESSION NUMBER: NCBI ACCESSION: NZ_QCYH01000003.1
  ref <309>: DATABASE ENTRY DATE: 2019-04-01
  ref <313>: RELEVANT RESIDUES IN SEQ ID NO: (1)..(1474)
tcaacttgagagtttgatcctggctcagaacgaacgctggcggcaggcttaacacatgcaagtcgagcgaggtcttcggacctagcggcggacgggttagtaacgcgtgggaacgtgcccttctctacggaatagtcctgggaaaccgggggtaataccgtatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgtgcgtaggcggatcagcaagttgggggtgaaatcccggggctcaaccccggaactgcctccaaaactgttggtctagagttcgagagaggtgagtggaattccgagtgtagaggtgaaattcgtagatattcggaggaacatcagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagttcggctggacgagatacaggtgctgcatggctgtcgtcagctcgtgtcgtgagatgttcggttaagtccggcaacgagcgcaacccacatccctagttgccagcaggtcaagctgggcactctatggaaactgcccgtgataagcgggaggaaggtgtggatgacgtcaagtcctcatggcccttacgggttgggctacacacgtgctacaatggtagtgacaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacctgtttacagggggcagcggaccacggtgagctcagcgactggggtgaagtcgtaacaaggtagccctaggggaacctggggctggatcacctcctttctaa

SEQ ID NO: 6632 - DNA, 1558 bp, Pelobacter acetylenicus
  ref <308>: DATABASE ACCESSION NUMBER: NCBI ACCESSION: NZ_CP015455.1
  ref <309>: DATABASE ENTRY DATE: 2019-04-01
  ref <313>: RELEVANT RESIDUES IN SEQ ID NO: (1)..(1558)
taactggagagtttgatcctggctcagaacgaacgctggcggcgtgcttaacacatgcaagtcgaacgcgaaagggacttcggtcctgagtaaagtggcgcacgggtgagtaacacgtggataatctacccgatggaccgggataacacttcgaaaggggtgctaataccggataagcccacaggctccctggagcttgcgggaaaaggtggggaccttcgggcctgccgtcatcggatgagtccgcggcccattagctagttggtggggtaacggcccaccaaggcgacgatgggtagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagaggggaagaaactgttgtggtcgaacaggccgcaagactgacggtaccctcaaaggaagcaccggctaactccgtgccagcagccgcggtaatacggagggtgcaagcgttgttcggaattattgggcgtaaagcgcgtgtaggcggttcgttaagtctgatgtgaaagcccggggctcaaccccggaagtgcattggatactggcggacttgagtacgggagagggaagtggaattccgagtgtaggggtgaaatccgtagatattcggaggaacaccggtggcgaaggcggcttcctggaccgatactgacgctgagacgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgcagaaccttacctgggcttgacatcccgatcgtactttctggaaacagagaggtcagttcggctggatcggtgacaggtgctgcatggctgtcgtcagctcgtgtcgtgagatgttgggttaagtcccgcaacgagcgcaacccttgtccttagttgccagcattgagttgggcactctaaggagactgccggtgttaaaccggaggaaggtggggatgacgtcaagtcctcatggcccttatgtccagggctacacacgtgctacaatggccggtacaaagggcagcaataccgaaaggtggagcgaatcccagaaagccggtctcagttcggattggagtctgcaactcgactccatgaagttggaatcgctagtaatcgcggatcagcatgccgcggtgaatacgttcccgggccttgtacacaccgcccgtcacaccacgggagttgattgtacctgaaatcggtgggctaaccttcggggggcagccgcttatggtatggtcggtaactggggtgaagtcgtaacaaggtagccgtaggggaacctgcggctggatcacctcctttct

SEQ ID NO: 6633 - DNA, 1560 bp, Pelobacter carbinolicus
  ref <308>: DATABASE ACCESSION NUMBER: NCBI ACCESSION: NC_007498.2
  ref <309>: DATABASE ENTRY DATE: 2019-04-01
  ref <313>: RELEVANT RESIDUES IN SEQ ID NO: (1)..(1560)
taactggagagtttgatcctggctcagaacgaacgctggcggcgtgcttaacacatgcaagtcgaacgcgaaagtttccttcgggaagcgagtagagtggcgcacgggtgagtaacacgtggataatctgcccgatgacctgggataacacttcgaaagaggtgctaataccggataagcccacaggctcttcggagcatgcgggaaaaggtggggaccttcgggcctaccgtcatcggatgagtccgcggcccattagctagttggtggggtaacggcccaccaaggcgacgatgggtagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagaggggaagaaactatcgtggtcgaataggccccggtactgacggtaccctcaaaggaagcaccggctaactccgtgccagcagccgcggtaatacggagggtgcaagcgttgttcggaattattgggcgtaaagcgcgtgtaggcggtctgttaagtctgatgtgaaagccccgggctcaacccgggaagtgcattggatactggcagacttgagtacgggagaggaaagtggaattccgagtgtaggggtgaaatccgtagatattcggaggaacaccggtggcgaaggcggctttctggaccgatactgacgctgagacgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgcagaaccttacctgggcttgacatcccgatcgtactttctggaaacagttaggtcagtacggctggatcggtgacaggtgctgcatggctgtcgtcagctcgtgtcgtgagatgttgggttaagtcccgcaacgagcgcaacccttgtccttagttgccagcattcagttgggcactctaaggagactgccggtgttaaaccggaggaaggtggggatgacgtcaagtcctcatggcccttatgtccagggctacacacgtgctacaatggccggtacaaagggcagcgaaaccgcaaggtttagcgaatcccaaaaagccggtctcagttcggattggagtctgcaactcgactccatgaagttggaatcgctagtaatcgcggatcagcatgccgcggtgaatacgttcccgggccttgtacacaccgcccgtcacaccacgggagttgattgtacctgaaatcggtgggctaaccttcgggaggcagccgcttatggtatggtcggtaactggggtgaagtcgtaacaaggtagccgtaggggaacctgcggctggatcacctcctttct

SEQ ID NO: 6634 - DNA, 1564 bp, Pelobacter propionicus
  ref <308>: DATABASE ACCESSION NUMBER: NCBI ACCESSION: NC_008609.1
  ref <309>: DATABASE ENTRY DATE: 2019-04-01
  ref <313>: RELEVANT RESIDUES IN SEQ ID NO: (1)..(1564)
ttaaactggagagtttgatcctggctcagaacgaacgctggcggcgtgcctaacacatgcaagtcgaacgggattaaggggcttgctccttaatctagtggcgcacgggtgagtaacgcgtagataatctgcctgatgatcaggaataacacttcgaaagaggtgctaatacctgataagcccacgacggctttggtcgttgcgggaaaagggggggaccatttggccttctgtcatcagatgagtctgcgtaccattagctagttggtagggtaaaggcctaccaaggcgacgatggttagctggtctgagaggatgatcagccacactggaactgagacacggtccagactcctacgggaggcagcagtggggaattttgcgcaatgggcgaaagcctgacgcagcaacgccgcgtgagtgatgaaggctttcgggtcgtaaagctctgtcaaggggaaagaagtgtattgtggttaatacccatggtacttgacggtacccctgaaggaagcaccggctaactccgtgccagcagccgcggtaatacggggggtgcaagcgttgttcggaattattgggcgtaaagcgcgtgtaggcggtttgttaagtctgatgtgaaagccctgggctcaacccaggaagtgcattggatactggcagacttgaatacgggagagggtagtggaattcctggtgtaggagtgaaatccgtagatatcaggaggaacaccggtggcgaaggcggctacctggaccgatattgacgctgagacgcgaaagcgtgggtagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatccacggaaccctcccgaaacggaggggtgcccttcggggagccgtgagacaggtgctgcatggctgtcgtcagctcgtgtcgtgagatgttgggttaagtcccgcaacgagcgcaacccctatcctcagttgccatcattaagttgggcactctgtggagactgccggtgtcaaaccggaggaaggtggggatgacgtcaagtcctcatggcccttatgtccagggctacacacgtgctacaatggccggtacaaagagtagcgaagccgcgaggttgagccaatctcataaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtgcgtgagctaacccgcaagggaggcagcgtcctaaggaatggtcggtgactggggtgaagtcgtaacaaggtagccgtaggggaacctgcggctggatcacctcctttctaa

SEQ ID NO: 6635 - DNA, 1559 bp, Pelobacter sp. SFB93
  ref <308>: DATABASE ACCESSION NUMBER: NCBI ACCESSION: NZ_CP015519.1
  ref <309>: DATABASE ENTRY DATE: 2019-04-01
  ref <313>: RELEVANT RESIDUES IN SEQ ID NO: (1)..(1559)
aactggagagtttgatcctggctcagaacgaacgctggcggcgtgcttaacacatgcaagtcgaacgagaaagggacttcggtcctgagtagagtggcgcacgggtgagtaacacgtggataatctacccaatgatctgggataacacttcgaaaggggtgctaataccggataagcccacaggctcttcggagcttgcgggaaaaggtggggaccttcgggcctaccgtcatcggatgagtccgcggcccattagctagttggtagggtaacggcctaccaaggcgacgatgggtagctggtctgagaggatgatcagccacactggaactgagacacggtccagactcctacgggaggcagcagtggggaattttgcgcaatgggcgaaagcctgacgcagcaacgccgcgtgagtgatgaaggctttcgggtcgtaaagctctgtcagtggggaagaaactcttgtggtctaatatgccgcaagactgacggtacccacaaaggaagcaccggctaactccgtgccagcagccgcggtaatacggagggtgcaagcgttgttcggaattattgggcgtaaagcgcgtgtaggcggtctattaagtctgatgtgaaagccccgggctcaacccgggaagtgcattggatactggtagacttgagtacgggagagggaagtggaattccgagtgtaggagtgaaatccgtagatattcggaggaacaccggtggcgaaggcggcttcctggaccgatactgacgctgagacgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgtagaaccttacctgggtttgacatcccgatcgcactttctggaaacagttaggtcagttcggctggatcggtgacaggtgctgcatggctgtcgtcagctcgtgtcgtgagatgttgggttaagtcccgcaacgagcgcaacccttgtccttagttgccatcattaagttgggcactctagggagactgccggtgttaaaccggaggaaggtggggatgacgtcaagtcctcatggcccttatatccagggctacacacgtgctacaatggccggtacaaagggcagctataccgcaaggtggagcgaatcccagaaagccggtctcagttcggattggagtctgcaactcgactccatgaagttggaatcgctagtaatcgcggatcagcatgccgcggtgaatacgttcccgggccttgtacacaccgcccgtcacaccacgggagttgattgtacctgaaatcggtgggctaaccttcgggaggcagccgcttatggtatgatcggtaactggggtgaagtcgtaacaaggtagccgtaggggaacctgcggctggatcacctcctttctaa

SEQ ID NO: 6636 - DNA, 1516 bp, Pelobium manganitolerans
  ref <308>: DATABASE ACCESSION NUMBER: NCBI ACCESSION: NZ_MBTA01000002.1
  ref <309>: DATABASE ENTRY DATE: 2019-04-01
  ref <313>: RELEVANT RESIDUES IN SEQ ID NO: (1)..(1516)
tggagagtttgatcctggctcaggatgaacgctagcggcaggcctaatacatgcaagtcgaggggtatcccgctttcgggcgggagagaccggcgcacgggtgcgtaacgcgtatgcaacctgcccttttctgggggatagcccggagaaatccggattaataccgcataagaccacgctatggcatcatagaggggtcaaacatttatgggaaaaggatgggcatgcgtgccattagctagttggcggggtaacggcccaccaaggcgacgatggctaggggatctgagaggatggccccccacactggtactgagacacggaccagactcctacgggaggcagcagtaaggaatattggtcaatgggggcaaccctgaaccagccatgccgcgtgcaggaagacggccctacgggttgtaaactgcttttgcacgggaacaaacctccccctgcggggggagctgagggtaccgtgagaataaggatcggctaactccgtgccagcagccgcggtaatacggaggatccgagcgttatccggatttattgggtttaaagggagcgtaggcggccctctaagtcaggggtgaaagacggcagctcaactgtcgcagtgcccttgatactggggggcttgaatgcacctgaggcaggcggaatgtggcaagtagcggtgaaatgcatagatatgccacagaacaccgattgcgaaggcagcttgctaaagtgctattgacgctgaggctcgaaagcgtggggatcgaacaggattagataccctggtagtccacgccctaaacgatgatgactcggtgccggcgatatactgccggcgcccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaatggcctagagataggccagtccttcgggacaggaaactaggtgctgcatggctgtcgtcagctcgtgccgtgaggtgttgggttaagtcccgcaacgagcgcaacccctatgtttagttgccagcacgttaaggtggggactctaaacagactgcccgcgcaagcggagaggaaggcggggacgacgtcaagtcatcatggcccttacgtccggggctacacacgtgctacaatgggcggcacagagggcagccaccccgcaagggggcgccaatcccgcaaagccgctcacagttcggatcggggcctgcaactcggccccgtgaagttggattcgctagtaatcgcgtatcagcaatgacgcggtgaatacgttcccgggccttgtacacaccgcccgtcaagccatggaagccgggggcgcctaaagtccgtagccgcaaggatcggcctagggcgaaactggtaactagggctaagtcgtaacaaggtagccgtaccggaaggtgcggctggaatacctccttt

SEQ ID NO: 6637 - DNA, 1504 bp, Pelodictyon luteolum
  ref <308>: DATABASE ACCESSION NUMBER: NCBI ACCESSION: NC_007512.1
  ref <309>: DATABASE ENTRY DATE: 2019-04-01
  ref <313>: RELEVANT RESIDUES IN SEQ ID NO: (1)..(1504)
caacggagagtttgatcctggctcaggacgaacgctggcggcgtgcctaacacatgcaagtcaaaggaaagcggcttcggccgggagtacttggcgcaagggtgagtaaggcataggtaatctgccctttggactgggataacctcgagaaatcgaggacaataccagatgatgcagcgggaccgcatggtcatgttgttaaagatttatcgccaagggatgagcctatgttccatcaggtagttggtagggtaacggcctaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgcaggggacgaacatgtcggtataccgacactgacggtaccttgcgaataagccacggctaactctgtgccagcagccgcggtgatacaggggtggcaagcgttgtccggatttactgggtgtaaagggtgcgcaggcggacttataagtcgggggttaaatccatgtgcttaacacatgcatggcttccgatactgtaagtctagagtctcggagaggaagatggaatttccggtgtaacggtggaatgtgtagatatcggaaagaacaccagtggcgaaggcagtcttctggccgagtactgacgctcaggcacgaaagcgtggggagcaaacaggattagataccctggtagtccacgccgtaaacgatgaatactagatgttggtcatattgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctaggcttgatattgcgactaaacctcctgaaagggagggtccttcggggagtcgtaacaggtgctgcatggctgtcgtcagctcgtgtcgtgagatgttgggttaagtcccgcaacgagcgcaacccctacaattagttactaacaggttaagctgaggactctaattgaactgcctacgcaagtagtgaggaaggaggggatgacgtcaagtcctcatggcccttacgcctagggccacacacgtgatacaatggcagctacagagggcaaagccgcgaggtggaggaaatcccttaaaagctgtctcagtccggatcggagtctgcaactcgactccgtgaagttggaatcgctagtaatcgcagatcagcatgctgcggtgaatgtgttcccgggccttgtacacaccgcccgtcaagtcatggaagtcaggagtacccaaagacgctcgcgcgtttaaggtaagactggtaactgggactaagtcgtaacaaggtagccgtaccggaaggtgcggctggatcacctccttttaat

SEQ ID NO: 6638 - DNA, 1502 bp, Pelodictyon phaeoclathratiforme
  ref <308>: DATABASE ACCESSION NUMBER: NCBI ACCESSION: NC_011060.1
  ref <309>: DATABASE ENTRY DATE: 2019-04-01
  ref <313>: RELEVANT RESIDUES IN SEQ ID NO: (1)..(1502)
caacggagagtttgatcctggctcaggacgaacgctggcggcgtgcctaacacatgcaagtcaaaggaaagcagcttcggctgggagtacttggcgcaagggtgagtaacgtataggtaatctgccctttggactggaataaccccgagaaatcggggacaataccagatgaagcagcgacaatcgcatggttgttctgccaaagatttatcgccaaaggatgaacctatatcccatcaggtagttggtaaggtaacggcttaccaagcctacgacgggtagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgtagaggaagaatatcccggtttaccgggactgacggtactctgcgaataagccacggctaactctgtgccagcagccgcggtgatacaggggtggcaagcgttgtccggatttactgggtgtaaagggtgcgcaggcgggccgataagtcgggggttaaatccatgtgcttaacacatgcatggcttccgatactgtcggcctagagtctcgaagaggaagatggaatttccggtgtaacggtggaatgtgtagatatcggaaagaacaccagtggcgaaggcagtcttctggtcgagcactgacgctcaggcacgaaagcgtggggagcaaacaggattagataccctggtagtccacgccgtaaacgatgaatactagatgttggtcatattgatcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctgggcttgatatggcgactaaactcattgaaagatgaggtgcttcggcgagtcgtcacaggtgctgcatggctgtcgtcagctcgtgtcgtgagatgttgggttaagtcccgcaacgagcgcaacccctacaattagttactaacaggttaagctgaggactctaattgaactgcctacgcaagtagtgaggaaggaggggatgacgtcaagtcctcatggcccttacgcccagggccacacacgtgatacaatggtagctacagagggcaaagccgcgaggcagagttaatcccttaaaagctatctcagtccggatcggagtctgcaactcgactccgtgaagttggaatcgctagtaatcgcagatcagcatgctgcggtgaatgtgttcccgggccttgtacacaccgcccgtcaagtcatggaagtcaggagtacccaaagacactcgcgtgtttaaggtaagactggtaactgggactaagtcgtaacaaggtagccgtaccggaaggtgcggctggatcacctcctttc

SEQ ID NO: 6639 - DNA, 1508 bp, Pelolinea submarina
  ref <308>: DATABASE ACCESSION NUMBER: NCBI ACCESSION: NZ_AP018437.1
  ref <309>: DATABASE ENTRY DATE: 2019-04-01
  ref <313>: RELEVANT RESIDUES IN SEQ ID NO: (1)..(1508)
ggagagtttgatcctggctcaggatgaacgctggcggcgtgcttaatacatgcaagtcgaacgaggaacttttgtcttcggatggaggtttcctagtggcgaacgggtgagtaacgcgttggtgacctgcctcgaagtgggggataacagttcgaaaggactgctaataccccatggtatctatagggttagagacctgttgattaaaggagtaatccgcttcgagaggggcctgcgtcccatcagcttgttggtagggtaaaagcctaccaaggctatgacgggtaggggacctgagagggtggccccccacaatggcactgaaacacgggccatacacctacgggtggcagcagtagggaatattggacaatgggcgaaagcctgatccagcaacgccgcgtgcgcgatgacggccttcgggttgtaaagcgcttttagaggagatgagaaaggacagtatcctctgaataagcctcggcgaactacgtgccagcagccgcggtaaaacgtaggaggctagcgttatccggatttattgggcgtaaagcgcgtgcaggcggtctagttagttggatgtgaaagctcctggcttaactgggagaggtcgttcaatactgctagactagagaatgggagagggaggtggaattccgggtgtagtggtgaaatgcgtagatatccggaggaacaccagtggcgaaagcggcctcctagaccacttctgacgctaagacgcgaaagctagggtagcaaacgggattagagaccccggtagtcctagccgtaaacgatgtggacttggcgttggcggagttaaatctgccagtgccgaagctaacgcgataagtccaccgcctggggactacgaccgcaaggttaaaactcaaaggaattgacggggacccgcacaagcagcggagcgtgtggtttaattcgatgctacacgaagaaccttaccaaggtttgacatgtaagtggtagtgatctgaaaagtgaacgacccttcggggagcttacacaggtgctgcatggctgtcgtcagctcgtgtcgtgagatgttcggttaagtccgctaacgagcgcaaccctcactgtgtgttacatgtgtcacacgggactgccggttttaagccggaggaaggcgaggatgacgtcaagtcagcatggcctttatatcttgggctacacacacgctacaatggtctgtacaataggttgccaagccgcgaggcggagccaatcctaaaagcaggcctcagttcagattgcaggctgcaacccgcctgcatgaagatggagttgctagtaaccgcaggtcagctatactgcggtgaatacgttcccgggtcttgtacacaccgcccgtcacgtcatggaagctggcaacacctgaagccggtatcctaaccgcaaggagggagccgtcgagggtggggtcggtgactgggacgaagtcgtaacaaggtaggtgtaccggaaggtgcgcctggatcacctcctttcta

SEQ ID NO: 6640 - DNA, 1532 bp, Pelomonas sp. BT06
  ref <308>: DATABASE ACCESSION NUMBER: NCBI ACCESSION: NZ_QXDH01000007.1
  ref <309>: DATABASE ENTRY DATE: 2019-04-01
  ref <313>: RELEVANT RESIDUES IN SEQ ID NO: (1)..(1532)
agatcgaactgtagagtttgatcctggctcagattgaacgctggcggcatgccttacacatgcaagtcgaacggtaacaggttaagctgacgagtggcgaacgggtgagtaatatatcggaacgtgcccagtcgtgggggataactgctcgaaagagcagctaataccgcatacgacctgagggtgaaagcgggggatcgcaagacctcgcgcgattggagcggccgatatcagattaggtagttggtggggtaaaagcccaccaagccaacgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaaaggttctggttaatacctgggactcatgacggtacctgaagaataagcaccggctaactacgtgccagcagccgcggtaatacgtagggtgcaagcgttaatcggaattactgggcgtaaagcgtgcgcaggcggttatgcaagacagaggtgaaatccccgggctcaacctgggaactgcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtctggaatcctgaagagatttgggagtgctcgaaagagagccagaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgtagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttcta

SEQ ID NO: 6641 - DNA, 1669 bp, Pelosinus fermentans
  ref <308>: DATABASE ACCESSION NUMBER: NCBI ACCESSION: NZ_FNKF01000002.1
  ref <309>: DATABASE ENTRY DATE: 2019-04-01
  ref <313>: RELEVANT RESIDUES IN SEQ ID NO: (1)..(1669)
ttttatggagagtttgatcctggctcaggacgaacgctggcggcgtgcctaacacatgcaagtcgaacggtctggtattcaacactgaatatttagcagtgtagccaagcgtcaagcgcgaaagaagagagcgcttcacgcatttaacaagtgccaacacaaaagctaaggattgagtgttgaatatcagatagtggcgaacgggtgagtaacgcgtagacaacctaccttctagctggggacaacactgcgaaagtggtgctaataccgaatgttgtattttgagtgcatacttaaaatactaaaggtggcctctatttataagctatcactagaagatgggtctgcgtctgattagctagttggtgaggtaatggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaaactctgttttcagggacgaatgtgtggattgtaaataatggttcataatgacggtacctgacaagaaagccacggctaactacgtgccagcagccgcggtaatacgtaggtggcaagcgttgtccggaattattgggcgtaaagcgcgcgcaggtgggataatcagtctgatgttaaagttcggggcttaaccccgtgaagcattggatactgttattcttgagtgcaggagaggaaagtggaattcctagtgtagcggtgaaatgcgtagatattaggaggaacaccagtggcgaaggcgactttctggactgtgtctgacactgaggcgcgaaagccagggtagtgaacgggattagataccccggtaatcctggccgtaaacgatgggtactaggtgttgggggtatcgacccctccagtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacatcgtctgatgatcctagagataggaagttcttcttcggaagacagatagacaggtggtgcatggctgtcgtcagctcgtgtcgtgagatgttgggttaagtcccgcaacgagcgcaacccttatcctatgttgccagcacgtaaaggtgggaactcatgggagactgccgtggataacacggaggaaggtggggatgacgtcaagtcatcatgccccttatgtcttgggctacacacgtactacaatgggcttaaatagagggtagcgaagccgcgaggtgaagccaaacccaaaaacaagctctcagttcggattgcaggctgcaactcgcctgcatgaagtcggaatcgctagtaatcgcagatcagcatgctgcggtgaatacgttcccgggccttgtacacaccgcccgtcacaccacgaaagttgagagcacccgaagccggtgaggtaaccagcaatggaaccagccgtcgaaggtgagatcagtgattggggtgaagtcgtaacaaggtagccgtatcggaaggtgcggctggatcacctcctttctatggaga

SEQ ID NO: 6642 - DNA, 1329 bp, Pelosinus sp. HCF1
  ref <308>: DATABASE ACCESSION NUMBER: NCBI ACCESSION: NZ_AMZI01000014.1
  ref <309>: DATABASE ENTRY DATE: 2019-04-01
  ref <313>: RELEVANT RESIDUES IN SEQ ID NO: (1)..(1329)
gggtctgcgtctgattagctagttggtgaggtaatggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaaactctgttttcagggacgaatgtgtggattgtaaataatggttcataatgacggtacctgacaagaaagccacggctaactacgtgccagcagccgcggtaatacgtaggtggcaagcgttgtccggaattattgggcgtaaagcgcgcgcaggtgggataatcagtctgatgttaaagttcggggcttaaccccgtgaagcattggatactgttattcttgagtgcaggagaggaaagtggaattcctagtgtagcggtgaaatgcgtagatattaggaggaacaccagtggcgaaggcgactttctggactgtgtctgacactgaggcgcgaaagccagggtagtgaacgggattagataccccggtaatcctggccgtaaacgatgggtactaggtgttgggggtatcgacccctccagtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacatcgtctgatgatcctagagataggaagttcttcttcggaagacagatagacaggtggtgcatggctgtcgtcagctcgtgtcgtgagatgttgggttaagtcccgcaacgagcgcaacccttatcctatgttgccagcacgtaaaggtgggaactcatgggagactgccgtggataacacggaggaaggtggggatgacgtcaagtcatcatgccccttatgtcttgggctacacacgtactacaatgggcttaaatagagggtagcgaagccgcgaggtgaagccaaacccaaaaacaagctctcagttcggattgcaggctgcaactcgcctgcatgaagtcggaatcgctagtaatcgcagatcagcatgctgcggtgaatacgttcccgggccttgtacacaccgcccgtcacaccacgaaagttgagagcacccgaagccggtgaggtaaccagcaatggaaccagccgtcgaaggtgagatcagtgattggggtgaagtcgtaacaaggtagccgtatcggaaggtgcggctggatcacctcctttctatggaga

SEQ ID NO: 6643 - DNA, 1670 bp, Pelosinus sp. UFO1
  ref <308>: DATABASE ACCESSION NUMBER: NCBI ACCESSION: NZ_CP008852.1
  ref <309>: DATABASE ENTRY DATE: 2019-04-01
  ref <313>: RELEVANT RESIDUES IN SEQ ID NO: (1)..(1670)
atttattggagagtttgatcctggctcaggacgaacgctggcggcgtgcctaacacatgcaagtcgaacggtctggtattcaacactgaatttttagcagtgtagcaagcgtcaagcgcgaaagaagagagcgcttcacgcatttacaaagtgctaacacaaaagcgaaagattgagtgttgaatatcagatagtggcgaacgggtgagtaacgcgtagacaacctaccttctagatggggacaacactgcgaaagtggtgctaataccgaatgttgtattttagatgcatatttaagatactaaaggtggcctctatttataagctaccactagaagatgggtctgcgtctgattagctagttggtgaggtaatggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaaactctgttttcagggacgaatgtgcgatatgtgaataatgtgttgtaatgacggtacctgacaagaaagccacggctaactacgtgccagcagccgcggtaatacgtaggtggcaagcgttgtccggaattattgggcgtaaagcgcgcgcaggtgggataataagtctgatgttaaagttcggggctcaaccccgtgaagcatttggatactgttattcttgagtgcaggagaggaaagtggaattcctagtgtagcggtgaaatgcgtagatattaggaggaacaccagtggcgaaggcgactttctggactgtgtctgacactgaggcgcgaaagccagggtagtgaacgggattagataccccggtaatcctggccgtaaacgatgggtactaggtgttgggggtatcgacccctccagtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacatcgtctgatgatcctagagataggaagttctccttcgggagacagatagacaggtggtgcatggctgtcgtcagctcgtgtcgtgagatgttgggttaagtcccgcaacgagcgcaacccttatcctatgttgccagcacgtaatggtgggaactcatgggagactgccgtggataacacggaggaaggtggggatgacgtcaagtcatcatgccccttatgtcttgggctacacacgtactacaatgggctttaatagagggtagcgaagccgcgaggtgaagccaaacccaaaaacaagctctcagttcggattgcaggctgcaactcgcctgcatgaagtcggaatcgctagtaatcgcagatcagcatgctgcggtgaatacgttcccgggccttgtacacaccgcccgtcacaccacgaaagttgagagcacccgaagccggtgaggtaaccagcaatggaaccagccgtcgaaggtgagatcagtgattggggtgaagtcgtaacaaggtagccgtatcggaaggtgcggctggatcacctcctttctatggaga

SEQ ID NO: 6644 - DNA, 1212 bp, Peptoclostridium litorale
  ref <308>: DATABASE ACCESSION NUMBER: NCBI ACCESSION: NZ_FSRH01000037.1
  ref <309>: DATABASE ENTRY DATE: 2019-04-01
  ref <313>: RELEVANT RESIDUES IN SEQ ID NO: (1)..(1212)
gatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctaagggaagataatgacggtaccttaggaggaagccccggctaactacgtgccagcagccgcggtaatacgtagggggcaagcgttatccggaatcactgggcgtaaagggtgcgtaggcggctgataaagtccgaggtgaaaggctacggcttaaccgtagtaagccttggaaacttatcagcttgagtacaggagaggaaagtggaattcctagtgtagcggtgaaatgcgtagatattaggaggaacaccagtggcgaaggcgactttctggactgttactgacgctgaggcacgaaagcgtggggagcgaacaggattagataccctggtagtccacgccgtaaacgatgagtgctaggtgtcgggggtcgaacctcggtgccgcagctaacgcattaagcactccgcctggggagtacgttcgcaagaataaaactcaaaggaattgacggggacccgcacaagcagcggagcatgtggtttaattcgaagcaacgcgaagaaccttacctggacttgacatccctttgaccgcttcttaaccgaagctttcccttcggggacaaaggtgacaggtggtgcatggttgtcgtcagctcgtgtcgtgagatgttgggttaagtcccgcaacgagcgcaacccctgtctttagttgccagcattaagttgggcactctagagagactgccgaggataactcggaggaaggtggggatgacgtcaaatcatcatgccccttatgttcagggctacacacgtgctacaatgggcggtacaacgggcagcaagctcgcgagagcaagccaatcccttaaagccgttctcagttcggattgtaggctgaaactcgcctacatgaagctggagttgctagtaatcgcggatcagaatgccgcggtgaatgcgttcccgggtcttgtacacaccgcccgtcacaccatggaagttgggggcgcccgaagtcagttatccaaccgcaagggggaggctgccgaaggtgaaatcaatgactggggtgaagtcgtaacaaggtagccgtatcggaaggtgcggctggatcacctcctttct

SEQ ID NO: 6645 - DNA, 1493 bp, Peptococcaceae bacterium CEB3
  ref <308>: DATABASE ACCESSION NUMBER: NCBI ACCESSION: NZ_LDXJ01000019.1
  ref <309>: DATABASE ENTRY DATE: 2019-04-01
  ref <313>: RELEVANT RESIDUES IN SEQ ID NO: (1)..(1493)
ttttacggagagtttgatcctggctcaggacgaacgctggcggcgtgcctaacacatgcaagtcgaacggagatattttgaagtttactttaggatatcttagtggcggacgggtgagtaacgcgtgggtaacctacccataaggccgggacaactcctggaaacgggggctaataccggataatctttccgagggacatctcttgggaaggaaaggcggcctctgaagatgctgccgtttatggatggacccgcgtctgattagctagttggtggggtaatggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgacgaaggccttcgggttgtaaagtactgtctttggggacgaacggcgtctatgtaaataatgtaggcgagtgacggtacccaaggaggaagccccggctaactacgtgccagcagccgcggtaatacgtagggggcgagcgttgtccggaattattgggcgtaaagggcgcgtaggcggatgcttaagtccggtgtgaaagactggggctcaaccccagggttgcatcggaaactgggtgtcttgaggacaggagaggaaagcggaattccacgtgtagcggtgaaatgcgtagatatgtggaggaacaccagtggcgaaggcggctttctggactgtaactgacgctgaggcgcgaaagcgtggggagcaaacaggattagataccctggtagtccacgccgtaaacgatgagtgctaggtgtagagggtatcgaccccctctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctgcgaacccttaggaaactaaggggtgcccttcggggagcgtagagacaggtggtgcatggttgtcgtcagctcgtgtcgtgagatgttgggttaagtcccgcaacgagcgcaacccctatctttagttgctaacaggtaagctgagcactctagagagactgccggtgacaaaccggaggaaggtggggatgacgtcaaatcatcatgccccttatgtcttgggctacacacgtgctacaatggccggtacagacggaagcgaagccgcgaggtgaagcgaatccgagaaagccggtctcagttcggattgttctctgcaactcgagagcatgaagtcggaatcgctagtaatcgcaggtcagcatactgcggtgaatacgttcccgggccttgtacacaccgcccgtcacaccacgaaagtctgcaacacccgaagccggtgaggtaaccgattcagaagtgagaggtaaga

SEQ ID NO: 6646 - DNA, 1534 bp, Peptoniphilus harei
  ref <308>: DATABASE ACCESSION NUMBER: NCBI ACCESSION: NZ_LR134524.1
  ref <309>: DATABASE ENTRY DATE: 2019-04-01
  ref <313>: RELEVANT RESIDUES IN SEQ ID NO: (1)..(1534)
tttaattgagagtttgatcctggctcaggacgaacgctggcggcgcgcttaacacatgcaagtcgagcgatgaaatcttgacagatcccttcggggtgaagataagatggattagcggcggacgggtgagtaacacgtgagtaacctgccttagacattgggatagcctcgggaaaccgggattaataccaaatgaaatcataggtgcccatgcactaatgatcaaaactccggtggtctaagatggactcgcgtcccattagctagttggtgaggtaacggcccaccaaggcgacgatgggtagccggcctgagagggtgaacggccacattggaactgagaaacggtccaaactcctacgggaggcagcagtggggaatattgcacaatggagggaactctgatgcagcgacgccgcgtgaacgatgaaggctttcgagtcgtaaagttcttttatatgggaagataatgacggtaccataagaaaaagccccggctaactacgtgccagcagccgcggtaatacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacaggattagataccctggtagtccacgctgtaaacgatgagtgctaggtatcggaataattcggtgccgcagttaacacattaagcactccgcctggggagtacgtgcgcaagcatgaaactcaaaggaattgacggggacccgcacaagcagcggagcatgtggtttaattcgaagcaacgcgaagaaccttaccagggcttgacatactgaggaccggtatagagatataccctcttcttcggaagcctcaatacaggtggtgcatggttgtcgtcagctcgtgtcgtgagatgttcagttaagtctggcaacgagcgcaacccctatctttagttaccagcatttcggatggggactctaaagagactgccgatgataaatcggaggaaggtggggatgacgtcaaatcatcatgccctatatgccctgggctacacacgtgctacaatggaagatacaaagggaagcgagatagtgatattaagccaacctcaaaaagtctttcccagttcggattgtactctgcaactcgagtacatgaagatggagttgctagtaatcgcagatcagcatgctgcggtgaatgcgttcccgggtcttgtacacaccgcccgtcacaccatggaagcttgtaatacccgaagcctgcgagcgaaccttagggaagcagcagtcgaaggtaggataggtgactggggtgaagtcgtaacaaggtagccgtatcggaaggtgcggctggatcacctcctttctaaggaa

SEQ ID NO: 6647 - DNA, 1530 bp, Peptoniphilus ivorii
  ref <308>: DATABASE ACCESSION NUMBER: NCBI ACCESSION: NZ_LR134523.1
  ref <309>: DATABASE ENTRY DATE: 2019-04-01
  ref <313>: RELEVANT RESIDUES IN SEQ ID NO: (1)..(1530)
tttattgagagtttgatcctggctcaggacgaacgctggcggcgcgcctaacacatgcaagtcgagcgatgaacctcttcggatcccttcggggtgaagaagagcggattagcggcggacgggtgagtaacgcgtgaggaacctgcctctcacaacgggatagcctcgggaaactgggattaataccgtatgagaccacagtaacgcctgttacagtggttaaagtcacagcggtgagagatggcctcgcgtctgattagctagttggtggggtaacggcctaccaaggctgcgatcagtaaccggcctgagagggtgaacggtcacattggaactgagacacggtccaaactcctacgggaggcagcagtggggaatcttgcacaatgggggcaaccctgatgcagcgacgccgcgtgagcgatgaaggctttcgagtcgtaaagctctgtcctatgggaagataatgacggtaccataggaggaagccccggctaactacgtgccagcagccgcggtaatacgtagggggcgagcgttgtccggaattactgggcgtaaagggttcgcaggcggctcggcaagtccgatgtaaaaggcgaaggcttaaccttcgcaagcatcggaaactgtcgagcttgagtgaaggagaggcaagtggaattcctagtgtagcggtggaatgcgtagatattaggaggaataccggtggcgaaggcgacttgctggacttcaactgacgctgaggaacgaaagcgtgggtagcaaacaggattagataccctggtagtccacgctgtaaacgatgagtgctaggtgtcgggggtcaaacctcggtgccgtcgttaacacaataagcactccgcctggggagtacgtgcgcaagcatgaaactcaaaggaattgacggggacccgcacaagcagcggagcatgtggtttaattcgaagcaacgcgaagaaccttaccgggacttgaaatattgtcgccaattttagagataaaatgttttcttcggaaacggcaatacaggtggtgcatggttgtcgtcagctcgtgtcgtgagatgttgggttaagtcccgcaacgagcgcaacccttactttcagttgccagcgcattatggcgggaactctggaaggactgccgatgataaatcggaggaaggtggggatgacgtcaaatcatcatgccctttatgtcccgggctacacacgtgctacaatggtcggtacagagggcagcgagacagcgatgttaagcgaatctcaaaaagccgatcccagttcggattgcaggctgcaactcgcctgcatgaagtcggagttgctagtaatcgcggatcagaatgccgcggtgaatgcgttcccgggtcttgtacacaccgcccgtcacaccatgggagttggcaatacccgaagccagcgagccaaccgtaaggaggcagctgtcgaaggtagggttaatgactggggtgaagtcgtaacaaggtagccgtatcggaaggtgcggctggatcacctcctttct

SEQ ID NO: 6648 - DNA, 1529 bp, Peptoniphilus lacydonensis
  ref <308>: DATABASE ACCESSION NUMBER: NCBI ACCESSION: NZ_FNWF01000003.1
  ref <309>: DATABASE ENTRY DATE: 2019-04-01
  ref <313>: RELEVANT RESIDUES IN SEQ ID NO: (1)..(1529)
ttttaattgagagtttgatcctggctcaggacgaacgctggcggcgcgcttaacacatgcaagtcgagcgatgaaactttaacagaacccttcggggcgaagataaagtggattagcggcggacgggtgagtaacacgtgagtaacctgccttagacattgggatagcctcgggaaaccgggattaataccaaataaaatcataatgacacatgtcataacgatcaaaactccggtggtctaagatggactcgcgtcccattagctagttggtagagtaaaagcctaccaaggcgacgatgggtagccggcctgagagggtgaacggccacattggaactgagaaacggtccaaactcctacgggaggcagcagtggggaatattgcacaatggagggaactctgatgcagcgacgccgcgtgaacgaagaaggctttcgagtcgtaaagttcttttatatgggaagataatgacggtaccataagaaaaagccccggctaactacgtgccagcagccgcggtaatacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacaggattagataccctggtagtccacgctgtaaacgatgagtgctaggtgtcggcgaatgtcggtgccgcagttaacacaataagcactccgcctggggagtacgtgcgcaagcatgaaactcaaaggaattgacggggacccgcacaagcagcggagcatgtggtttaattcgaagcaacgcgaagaaccttaccagggcttgacatactgaggacgtacttagagataagtatacttcttcggaagcctcaatacaggtggtgcatggttgtcgtcagctcgtgtcgtgagatgttgggttaagtcccgcaacgagcgcaacccctatctttagttgccagcatataagatgggaactctaaagagactgccgatgataaatcggaggaaggtggggatgacgtcaaatcatcatgccctatatgccctgggctacacacgtgctacaatggaaggtacaaagggaagcaacagagtgatctcaagcaaacctcaaaaagcctttcccagttcggattgtactctgcaactcgagtacatgaagatggagttgctagtaatcgcagatcagaatgctgcggtgaatgcgttcccgggtcttgtacacaccgcccgtcacaccatgggagcttgtaatacccgaagcctgtgagcaaaccgtaaggtagcagcagtcgaaggtaggataagtgactggggtgaagtcgtaacaaggtagccgtatcggaaggtgcggctggatcacctcctttct

SEQ ID NO: 6649 - DNA, 1538 bp, Peptoniphilus sp. ChDC B134
  ref <308>: DATABASE ACCESSION NUMBER: NCBI ACCESSION: NZ_AUQY01000002.1
  ref <309>: DATABASE ENTRY DATE: 2019-04-01
  ref <313>: RELEVANT RESIDUES IN SEQ ID NO: (1)..(1538)
tttcaattgagagtttgatcctggctcaggacgaacgctggcggcgcgcctaacacatgcaagtcgagcgatgaaaaggatttggagttcttcgggacaaagaaaccttggattagcggcggacgggtgagtaacacgtgagtaacctgcctttgacatggggatagcctcgggaaaccgtgattaatacccaataacatttccaagtcgcatgacatggaaatcaaagcgtttagcggtcaaagatggactcgcgtctgattaattagttggtgaggtaacggctcaccaagatagcgatcagtagccggcctgagagggtgaacggccacattggaactgagagacggtccaaactcctacgggaggcagcagtggggaatattgcacaatggggggaaccctgatgcagcgacgccgcgtgagcgaagaaggttttcgaatcgtaaagctctgtcctatgggaagataatgacggtaccataggaggaagccccggctaactacgtgccagcagccgcggtaatacgtagggggctagcgttgtccggaatcactgggcgtaaagggttcgcaggcggaaaagcaagtcaggtgtgaaaggcgagggcttaaccctcgtaagcatttgaaactgtttttcttgagatgtggagaggtaagtggaattcctagtgtagcggtgaaatgcgtagatattaggaggaataccggtggcgaaggcgacttactggacacaaactgacgctgaggaacgaaagcgtggggagcaaacaggattagataccctggtagtccacgctgtaaacgatgagtgctaggtgtcgggagtaatctcggtgccgcagtaaacacaataagcactccgcctggggagtacgtacgcaagtatgaaactcaaaggaattgacggggacccgcacaagcagcggagcatgtggtttaattcgaagcaacgcgaagaaccttaccagggcttgacatatagtggacatatttagagataaatacttttcttcggaaaccgctatacaggtggtgcatggttgtcgtcagctcgtgtcgtgagatgttgggttaagtcccgcaacgagcgcaacccttacctttagttgccagcatgtaaagatgggaactctaaagggactgccgatgataaatcggaggaaggtggggatgacgtcaaatcatcatgccctatatgccctgggctacacacgtgctacaatggtcggaacaaagggtagcaaacttgtgaaagtaagcaaatctcaaaaagccgatctcagttcggattgttctctgcaactcgagaacatgaagtcggagttgctagtaatcgcagatcagaatgctgcggtgaatgcgttcccgggtcttgtacacaccgcccgtcacaccatgggagttggcaatacccgaagcctgtgagctaaccttaggggagcagcagtcgaaggtagggttaatgactggggtgaagtcgtaacaaggtagccgtatcggaaggtgcggctggatcacctcctttctaagga

SEQ ID NO: 6650 - DNA, 1530 bp, Peptoniphilus sp. Marseille-P3761
  ref <308>: DATABASE ACCESSION NUMBER: NCBI ACCESSION: NZ_OPYI01000032.1
  ref <309>: DATABASE ENTRY DATE: 2019-04-01
  ref <313>: RELEVANT RESIDUES IN SEQ ID NO: (1)..(1530)
tttattgagagtttgatcctggctcaggacgaacgctggcggcgcgcctaacacatgcaagtcgagcgatgaacattgaatgatcccttcggggtgatttcgatcggattagcggcgaacgggtgagtaacgcgtgaggaacctgcctcttacaacgggatagcctcgggaaaccgggattaataccgtataagactccgacacctcctggtgatgaagtcaaagcgttagcggtaagagatggcctcgcgtctgattagcttgttggcggggtaacggcccaccaaggcgacgatcagtaaccggcctgagagggtgaacggtcacattggaactgagacacggtccaaactcctacgggaggcagcagtggggaatcttgcacaatgggggaaaccctgatgcagcgacgccgcgtgagcgatgaaggttttcgaatcgtaaagctctgtcctatgggaagataatgacggtaccatgggaggaagccccggctaactacgtgccagcagccgcggtaatacgtagggggcgagcgttgtccggaattactgggcgtaaagggttcgcaggcggcatggcaagtccgatgtaaaaggcgaaggctcaaccttcgtaagcatcggaaactgtcaagcttgagtgaaggagaggcaagtggaattcctagtgtagcggtggaatgcgtagatattaggaggaataccggtggcgaaggcgacttgctggacttcaactgacgctgaggaacgaaagcgtgggtagcaaacaggattagataccctggtagtccacgccgtaaacgatgagtgctaggtgtcgggggtcaaacctcggtgccgccgttaacacaataagcactccgcctggggagtacgtgcgcaagcatgaaactcaaaggaattgacggggacccgcacaagcagcggagcatgtggtttaattcgaagcaacgcgaagaaccttaccaggacttgaaatactagcgcccgctttagagataaagttttttcttcggaaacgctaatacaggtggtgcatggttgtcgtcagctcgtgtcgtgagatgttgggttaagtcccgcaacgagcgcaacccttacttttagttgccagcacgtaaaggtgggaactctaaagggactgccgatgataaatcggaggaaggtggggatgacgtcaaatcatcatgccctttatgtcctgggctacacacgtgctacaatggtcggtacagagggcagcaaacgagcgatcgcaagcgaatctcaaaaagccgatcccagttcggattgcaggctgcaactcgcctgcatgaagtcggagttgctagtaatcgcgaatcagaatgtcgcggtgaatgcgttcccgggtcttgtacacaccgcccgtcacaccatgggagttggcaatacccgaagccagcgagccaaccgcaaggaggcagctgtcgaaggtagggttaatgactggggtgaagtcgtaacaaggtagccgtatcggaaggtgcggctggatcacctcctttct

SEQ ID NO: 6651 - DNA, 1541 bp, Peptostreptococcaceae bacterium oral taxon 929
  ref <308>: DATABASE ACCESSION NUMBER: NCBI ACCESSION: NZ_CP027242.1
  ref <309>: DATABASE ENTRY DATE: 2019-04-01
  ref <313>: RELEVANT RESIDUES IN SEQ ID NO: (1)..(1541)
tttaatcgagagtttgatcctggctcaggacgaacgctggcggcgtgcttaacacatgcaagtcgaacgatgaaagagaatccgatctcttcggagtgaagaatctctggattagtggcggacgggtgagtaacgcgtgagcaatctgccttacacaaagggatagcctcgggaaaccgggattaataccatatgatatctcaacttcgcatgaagatgagattaaagaatttcggtgtaagatgagctcgcgtcccattaattagttggtgagggtaacggcccaccaagatagcgatgggtagccgatctaagaggatgaccggccacattggaactgagaaacggtccaaactcctacgggaggcagcagtggggaatattgcacaatgggggaaaccctgatgcagcgacgccgcgtgagcgatgaaggctttcgagtcgtaaagctctgtcctatgggaagataatgacggtaccatagaagaaagccccggctaattacgtgccagcagccgcggtaatacgtaaggggcgagcgttgtccggaattattgggcgtaaagagtgcgtaggcggcaaattaagtcagatgtgaaaactaagggctcaacccatagattgcatctgaaactgatatgcttgagtcaaggagaggaaagtggaattcctagtgtagcggtggaatgcgtagatattaggaggaataccggtggcgaaggcgactttctggacttgaactgacgctgaggcacgaaagcgtggggagcaaacaggattagataccctggtagtccacgccgtaaacgatgagtgctaggtgtctgctcatacgagtaggtgccgtacgttaacacattaagcactccgcctggggagtacgtacgcaagtatgaaactcaaaggaattgacggggacccgcacaagcagcggagcatgtggtttaattcgaggctacgcgaagaaccttaccaggacttgacataccaaggaaagtttttagagataaaaaccctagatttatctaccttggatacaggtggtgcatggttgtcgtcagctcgtgtcgtgagatgttgggttaagtcccgcaacgagcgcaacccttacatttagttactaacaggtagtgctgaggactctagatggactgccgatgacaaatcggaggaaggtggggatgacgtcaaatcatcatgccctttatgtcctgggctacacacgtgctacaatggtcggtacaaagagaagcgaaatagcgatatcaagcaaacctcaaaaaaccgatcccagttcggattgatctctgcaactcgagatcatgaagccggagttgctagtaatcgcagatcagaatgctgcggtgaatgcgttcccgggtcttgtacacaccgcccgtcacaccatgggagtaggcaatacccgaagcctgtgagctaaccgtaaggaggcagcagtcgaaggtagggtcaatgactggggtgaagtcgtaacaaggtagccgtatcggaaggtgcggctggatcacctcctttctaag

SEQ ID NO: 6652 - DNA, 1547 bp, Persephonella marina
  ref <308>: DATABASE ACCESSION NUMBER: NCBI ACCESSION: NC_012440.1
  ref <309>: DATABASE ENTRY DATE: 2019-04-01
  ref <313>: RELEVANT RESIDUES IN SEQ ID NO: (1)..(1547)
tggagagtttgatcctggctcagcgcgaacgttggcggcgcgcctaacacatgcaagtcgtggggcagcaggccacttcttcgggagtggtgctggcgaccggcgaacgggtgagtaacacgtagctgacctaccccagggatggggataaccctccgaaaggggggctaatacccaataacgagccctgtataatgatggggttccaaaggcctacgggcgccctgggatggggctgcgtcccatcagctagttggtgaggtaacggctcaccaaggctacgacgggtagccggcctgagagggtggccggccacagtgggactgagacacggcccgcacccctacggggggcagcagtggggaatattgggcaatggccgaaaggctgacccagcgacgccgcgtggtggaagaagcccttcggggtgtaaacacctgtcaggggggaagatgatgacggtacccccagaggaagggacggctaactacgtgccagcagccgcggtaatacgtaggtcccgaacgttgcgcgaaattactgggcgtaaagggtccgtaggcggtctggtaagtggaaggtgaaagcccacggctcaaccgtggaattgccttccaaactgctggacttgagggcggaagaggtcggcggaattcccggtgtagcggtgaaatgcgtagatatcgggaggaacaccggtggcgaaggcggccgactgggacgcacctgacgctgagggacgaaagccaggggagcgaaccggattagatacccgggtagtcctggccgtaaacgatgggtgctagatgtgggcggggatatcccgtccgtgtcgtaagctaacgcgttaagcaccccgcctggggagtacgggcgcaagcctgaaactcaaaggaattgacggggacccgcacaaccggtggagcgtctggtttaattcgatgctaaccgaaaaacctcaccagggcttgacatgcggtgtgtcgtgcccgaaagggtgctaggttactcttcggagtaaccgcgccgcacaggtggtgcatggccgtcgtcagctcgtgtcgtgagatgttgggttaagtcccgcaacgagcgcaacccttgccctgtgttaccagcgggtgaagccgggtactcacaggggactgccggcgataagtcggaggaaggaggggatgacgtcaggtcagtatgccctttatgccctgggctacacaggcgctacagtggcagggacaaagggaagcgaagccgcaaggtggagcaaatcccaaaaaccctgtcgtggtgcggattgggggttgcaactcacccccatgaaggcggaatcggtagtaatggcgaatcagcaatgtcgccgtgaatacgttcccgggtcttgtacacaccgcccgtcacgccacgggagttgggtccatcggaagtccccgggctaaccgtcttcggacggaggcaggggccgatgatgggcctggcgactggggcgaagtcgtaacaaggtagccgtaggggaacctgcggctggatcacctcctttataagggaaa

SEQ ID NO: 6653 - DNA, 1553 bp, Persephonella sp. IF05-L8
  ref <308>: DATABASE ACCESSION NUMBER: NCBI ACCESSION: NZ_JNLJ01000001.1
  ref <309>: DATABASE ENTRY DATE: 2019-04-01
  ref <313>: RELEVANT RESIDUES IN SEQ ID NO: (1)..(1553)
ttttattggagagtttgatcctggctcagcgcgaacgttggcggcgcgcctaacacatgcaagtcgtggggcagcaggccgctccttcgggagcggtgctggcgaccggcgaacgggtgagtaacacgtagctaacctaccccgaggatggggataaccccccgaaaggggggctaatacccaataatgagtcctatgtaatgatgggactccaaaggccttcgggcgcctcgggatggggctgcgtcccatcagcttgttggtgaggtaacggctcaccaaggctacgacgggtagccggcctgagagggtggccggccacagtgggactgagacacggcccgcacccctacggggggcagcagtggggaatattgggcaatggccgaaaggctgacccagcgacgccgcgtggtggatgaagcccttcggggtgtaaacacctgtcaggggggaagataatgacggtacccccagaggaagggacggctaactacgtgccagcagccgcggtaatacgtaggtcccgaacgttgcgcgaaattactgggcgtaaagggtccgtaggcggtctggtaagtggaaggtgaaagcctggggctcaactccagaattgccttccaaactgccggacttgaggcagggagaggtcggcggaattcccggtgtagcggtgaaatgcgtagatatcgggaggaacaccagtggcgaaggcggccgactggaactgtcctgacgctgagggacgaaagccaggggagcaaaccggattagatacccgggtagtcctggccgtaaacgatgggtgctagatgtgggtgccgataggcatccgtgtcgcaagctaacgcgttaagcaccccgcctggggagtacggtcgcaaggctgaaactcaaaggaattgacggggacccgcacaaccggtggagcgtctggtttaattcgatgctaaccgaaaaacctcaccagggcttgacatgcggtgtgtcgtacccgaaagggtactaggtgtcccttcggggacaccgcgccgcacaggtggtgcatggccgtcgtcagctcgtgtcgtgagatgttgggttaagtcccgcaacgagcgcaacccttgccctgtgttaccagcgggtaaagccgggtactcacaggggactgccggcgataagtcggaggaaggaggggatgacgtcaggtcagtatgccctttatgccctgggctacacaggcgctacagtggcagggacagagggaagcgaagccgcaaggtggagcaaatcccaaaaaccctgtcgtggtgcggattgggggttgcaactcacccccatgaaggcggaatcggtagtaatggcggatcagcaatgccgccgtgaatacgttcccgggtcttgtacacaccgcccgtcacgccacgggagtcgggtctgtcggaagtccccgggctaaccggccttcgggccggaggcaggggccgatgacaggcctggcgactggggcgaagtcgtaacaaggtagccgtaggggaacctgcggctggatcacctcctttatagggaaa

SEQ ID NO: 6654 - DNA, 1554 bp, Persephonella sp. KM09-Lau-8
  ref <308>: DATABASE ACCESSION NUMBER: NCBI ACCESSION: NZ_JNLL01000001.1
  ref <309>: DATABASE ENTRY DATE: 2019-04-01
  ref <313>: RELEVANT RESIDUES IN SEQ ID NO: (1)..(1554)
ttttattggagagtttgatcctggctcagcgcgaacgttggcggcgcgcctaacacatgcaagtcgaggggcagcaggccgctccttcgggagcggtgctggcgaccggcgaacgggtgagtaacacgtagctaacctaccccgaggatggggataaccccccgaaaggggggctaatacccaataaagagtcctgtttaatgatgggactccaaaggcctttttggcgcctcgggatggggctgcgtcccatcagctagttggtgaggtaacggctcaccaaggctacgacgggtagccggcctgagagggtggccggccacagtgggactgagacacggcccgcacccctacggggggcagcagtggggaatattgggcaatggccgaaaggctgacccagcgacgccgcgtggtggaagaagcccttcggggtgtaaacacctgtcaggggggaagataatgacggtacccccagaggaagggacggctaactacgtgccagcagccgcggtaatacgtaggtcccgaacgttgcgcgaaattactgggcgtaaagggtccgtaggcggtctggtaagtggaaggtgaaagcctggggctcaactccagaattgccttccaaactgccggacttgaggcagggagaggtcggcggaattcccggtgtagcggtgaaatgcgtagatatcgggaggaacaccagtggcgaaggcggccgactggaactgtcctgacgctgagggacgaaagccaggggagcgaaccggattagatacccgggtagtcctggccgtaaacgatgggtgctagatgtgggtgccgataggcatccgtgtcgcaagctaacgcgttaagcaccccgcctggggagtacggtcgcaaggctgaaactcaaaggaattgacggggacccgcacaaccggtggagcgtctggtttaattcgatgctaaccgaaaaacctcaccagggcttgacatgcggtgtgtcgtacccgaaagggtactaggtgtcccttcggggacaccgcgccgcacaggtggtgcatggccgtcgtcagctcgtgtcgtgagatgttgggttaagtcccgcaacgagcgcaacccttgccctgtgttaccagcgggtaaagccgggtactcacaggggactgccggcgataagtcggaggaaggaggggatgacgtcaggtcagtatgccctttatgccctgggctacacaggcgctacagtggcagggacagagggaagcgaagccgcaaggtggagcaaatcccaaaaaccctgtcgtggtgcggattgggggttgcaactcacccccatgaaggcggaatcggtagtaatggcgaatcagcaatgtcgccgtgaatacgttcccgggtcttgtacacaccgcccgtcacgccacgggagtcgggtctgtcggaagtccccgggctaaccggccttcgggccggaggcaggggccgatgacaggcctggcgactggggcgaagtcgtaacaaggtagccgtaggggaacctgcggctggatcacctcctttatagggaag

SEQ ID NO: 6655 - DNA, 1529 bp, Persicobacter sp. CCB-QB2
  ref <308>: DATABASE ACCESSION NUMBER: NCBI ACCESSION: NZ_LBGV01000002.1
  ref <309>: DATABASE ENTRY DATE: 2019-04-01
  ref <313>: RELEVANT RESIDUES IN SEQ ID NO: (1)..(1529)
tacaatggagagtttgatcctggctcaggatgaacgctagcggcaggcctaatacatgcaagtcgaggggtaacagggaagcttgcttccgctgacgaccggcgcacgggtgcgtaacgcgtatacaatctgcccttaactggaggatagccactggaaacagtgattaatactccataacactgcacgatcgcatgagagagcagttaaagaatttcggttaaggatgagtatgcgtgacattagctagttggtgaggtaacggctcaccaaggcaacgatgtctaggggttctgagaggatgatcccccacactggtactgagacacggaccagactcctacgggaggcagcagtagggaatattgggcaatggaggcaactctgacccagccatgccgcgtgcaggatgaaggcgttctgcgttgtaaactgcttttatatgggaagaaaaaggtcttgcgagacaaactgacggtaccatatgaataagcaccggctaactccgtgccagcagccgcggtaatacggagggtgcaagcgttatccggatttattgggtttaaagggtgcgcaggcggcctattaagtcagtggtgaaatcttacagcttaactgtgaaagtgccattgatactggtaggcttgagtgcggtgaaggtaggcggaattcctcatgtagcggtgaaatgcatagatatgaggaagaacaccgatagcgaaggcagcttactgtaccgttactgacgctcatgcacgaaagcgtggggagcgaacaggattagataccctggtagtccacgccgtaaacgatgattactcggtgttggcgatagattgtcagcgcccaagcgaaagcgttaagtaatccacctggggagtacgccggcaacggtgaaactcaaaggaattgacgggggtccgcacaagcggtggagcatgtggtttaattcgatgatacgcgaggaaccttacctgggctcgaatgtgagcgacggttccagaaatggaactttcttcggacgcgaaacaaggtgctgcatggctgtcgtcagctcgtgccgtgaggtgttgggttaagtcccgcaacgagcgcaacccctactgttagttaccatcagataatgctggggactctaacagaactgcctacgcaagtagtgaggaaggcggggacgacgtcaagtcatcatggcccttacgcccagggctacacacgtgctacaatggccagtacagagggtcgctacctggcaacaggatgccaatctcaaaaagctggtctcagttcggatcggagtctgcaactcgactccgtgaagttggaatcgctagtaatcgcgcatcagcaatggcgcggtgaatacgttcccggaccttgtacacaccgcccgtcaagccatggaagtcagggggacctgaagcaggtgaccgtaataggagcttgttagggttaaactggtaactagggctaagtcgtaacaaggtagccgtaccggaaggtgcggctggaacacctcctttctggag

SEQ ID NO: 6656 - DNA, 1529 bp, Persicobacter sp. JZB09
  ref <308>: DATABASE ACCESSION NUMBER: NCBI ACCESSION: NZ_CP012859.1
  ref <309>: DATABASE ENTRY DATE: 2019-04-01
  ref <313>: RELEVANT RESIDUES IN SEQ ID NO: (1)..(1529)
tacaatggagagtttgatcctggctcaggatgaacgctagcggcaggcctaatacatgcaagtcgaggggtaacagggaagcttgcttccgctgacgaccggcgcacgggtgcgtaacgcgtatacaatctgcccttaactggaggatagccactggaaacagtgattaatactccataacactgcacgatcgcatgagagagcagttaaagaatttcggttaaggatgagtatgcgtgacattagctagttggtgaggtaacggctcaccaaggcaacgatgtctaggggttctgagaggatgatcccccacactggtactgagacacggaccagactcctacgggaggcagcagtagggaatattgggcaatggaggcaactctgacccagccatgccgcgtgcaggatgaaggcgttctgcgttgtaaactgcttttatatgggaagaaaaaggtcttgcgagacaaactgacggtaccatatgaataagcaccggctaactccgtgccagcagccgcggtaatacggagggtgcaagcgttatccggatttattgggtttaaagggtgcgcaggcggcctattaagtcagtggtgaaatcttacagcttaactgtgaaagtgccattgatactggtaggcttgagtgcggtgaaggtaggcggaattcctcatgtagcggtgaaatgcatagatatgaggaagaacaccgatagcgaaggcagcttactgtaccgttactgacgctcatgcacgaaagcgtggggagcgaacaggattagataccctggtagtccacgccgtaaacgatgattactcggtgttggcgatagattgtcagcgcccaagcgaaagcgttaagtaatccacctggggagtacgccggcaacggtgaaactcaaaggaattgacgggggtccgcacaagcggtggagcatgtggtttaattcgatgatacgcgaggaaccttacctgggctcgaatgtgagcgacggttccagaaatggaactttcttcggacgcgaaacaaggtgctgcatggctgtcgtcagctcgtgccgtgaggtgttgggttaagtcccgcaacgagcgcaacccctactgttagttaccatcagataatgctggggactctaacagaactgcctacgcaagtagtgaggaaggcggggacgacgtcaagtcatcatggcccttacgcccagggctacacacgtgctacaatggccagtacagagggtcgctacctagcaataggatgccaatctcaaaaagctggtctcagttcggatcggagtctgcaactcgactccgtgaagttggaatcgctagtaatcgcgcatcagcaatggcgcggtgaatacgttcccggaccttgtacacaccgcccgtcaagccatggaagtcagggggacctgaagcaggtgaccgtaataggagcttgttagggttaaactggtaactagggctaagtcgtaacaaggtagccgtaccggaaggtgcggctggaacacctcctttctggag

SEQ ID NO: 6657 - DNA, 1522 bp, Petroclostridium xylanilyticum
  ref <308>: DATABASE ACCESSION NUMBER: NCBI ACCESSION: NZ_NPML01000010.1
  ref <309>: DATABASE ENTRY DATE: 2019-04-01
  ref <313>: RELEVANT RESIDUES IN SEQ ID NO: (1)..(1522)
tatattgagagtttgatcctggctcaggacgaacgctggcggcgtgcctaacacatgcaagtcgagcggaggtattgaagggaaacctaagataccttagcggcggacgggtgagtaacgcgtgaggaacctgccttatacagggggataacacatcgaaagatgtgctaataccgcataaagtcatcaggacgcatgtcgtgatgaccaaaggagcaatccggtataagatggcctcgcgtctgattagctagttggcagggtaacggcctaccaaggcgacgatcagtagccgacctgagagggtgaccggccacattgggactgagacacggcccagactcctacgggaggcagcagtggggaatattgcgcaatgggggaaaccctgacgcagcaacgccgcgtggaggaagaaggtcttcggatcgtaaactcttgtctttagggacgaaagatgacggtacctaaggaggaagccacggctaactacgtgccagcagccgcggtaatacgtaggtggcgagcgttgtccggaattactgggtgtaaagggcgtgtaggcgggtaagcaagtcagatgtgaaataccggggctcaaccccggggctgcatttgaaactgcatatcttgagtgcaggagagggaagcggaattcctagtgtagcggtgaaatgcgtagatattaggaggaacaccagtggcgaaggcggcttcctggactgtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccggtgaatcctctagagataggggagtgccttcgggaacactgagacaggtggtgcatggttgtcgtcagctcgtgtcgtgagatgttgggttaagtcccgcaacgagcgcaacccttgttgttagttgccagcattaagttgggcactctagcgagactgccggtgacaaatcggaggaaggtggggacgacgtcaaatcatcatgccccttatgtcctgggctacacacgtactacaatggctgtcaacaaagggaagcaagaccgtgaggtggagcaaatccccaaaagcagtcccagttcagattgtaggctgcaactcgcctacatgaagtcggaattgctagtaatcgcggatcagcatgccgcggtgaatacgttcccgggccttgtacacaccgcccgtcacaccatgagagtcggcaacacccgaagcctgtgagctaacggaagaggcagcagtcgaaggtggggccgatgattggggtgaagtcgtaacaaggtagccgtatcggaaggtgcggctggatcacctcctttcta

SEQ ID NO: 6658 - DNA, 1006 bp, Petrotoga halophila
  ref <308>: DATABASE ACCESSION NUMBER: NCBI ACCESSION: NZ_JALY01000085.1
  ref <309>: DATABASE ENTRY DATE: 2019-04-01
  ref <313>: RELEVANT RESIDUES IN SEQ ID NO: (1)..(1006)
aggatgaagggtttgatcctggctcagggtaaacgctggcggcgtgcgtaacacatgcaagtcggacgggttatacatcttcggatgtataatcagtggcgaacgggtgagtaaaaggtagggacctaccccgaggacagagatagctactggaaacggtaggtaaactctgataagcccgagaggggaaagtgggagtcagccttgggatggacctactatccatcaggtagttggtgaggtaaaggcttaccaagccgatgacggataaccggtgtgagagcatggacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataagagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaagattgctcaacgattggcttgcggatgaaactggtcatcttgggcgtagcagaggtagacggaattacctgagtaggggtgaaatccgcagatacaggtaagaaggccggtgaagaagttggtctactgggctacagctgacgctgaggtccgaaagccaggggagcgaaccggattagatacccgggtagtcctggctgtaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctgccg

SEQ ID NO: 6659 - DNA, 1496 bp, Petrotoga mexicana
  ref <308>: DATABASE ACCESSION NUMBER: NCBI ACCESSION: NZ_AZRN01000028.1
  ref <309>: DATABASE ENTRY DATE: 2019-04-01
  ref <313>: RELEVANT RESIDUES IN SEQ ID NO: (1)..(1496)
agggtaaacgctggcggcgtgcgtaacacatgcaagtcggacgggttatacttcttaggaagtataatcagtggcgaacgggtgagtaaaaggtagggacctaccccgaggacagagatagctactggaaacggtaggtaaactctgataagcccgagaggggaaagtggaaggcagccttgggatggacctactatccatcaggtagttggtgaggtaaaggcttaccaagccgatgacggataaccggtgtgagagcatgtacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataaaagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaagattgctcaacgattggcttgcggatgaaactggtcatcttgggcgtagcagaggtagacggaattacctgagtaggggtgaaatccgcagatacaggtaagaacgccggtgaagaagttggtctactgggctacagctgacgctgaggtccgaaagccaggggagcgaaccggattagatacccgggtagtcctggctgtaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctgccgcaaggcagggggttacacaggtggtgcacggtcgtcgtcagctcgtgccgtgaggtgttgggttaagtcccacaacgagcgcaacccctacgattagttaccagcaagtaaagttgggtacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggcaggtactgttgaaggtgggcttggcgaggggggcgaagtcgtaacaaggtaggtgtaccggaaggtgcgcctggatcacctcctttctaaggaga

SEQ ID NO: 6660 - DNA, 1521 bp, Petrotoga miotherma
  ref <308>: DATABASE ACCESSION NUMBER: NCBI ACCESSION: NZ_AZRM01000039.1
  ref <309>: DATABASE ENTRY DATE: 2019-04-01
  ref <313>: RELEVANT RESIDUES IN SEQ ID NO: (1)..(1521)
aggatgaagggtttgatcctggctcagggtaaacgctggcggcgtgcgtaacacatgcaagtcgaacgggttatacatcttcggatgtataatcagtggcgaacgggtgagtaaaaggtagggacctaccccgaggacagagatagctactggaaacggtaggtaaactctgataagcccgagaggggaaagtgggagtcagccttgggatggacctactatccatcaggtagttggtgaggtaaaggcttaccaagccgatgacggataaccggtgtgagagcatggacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataagagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaagattgctcaacgattggcttgcggatgaaactggtcatcttgggcgtagcagaggtagacggaattacctgagtaggggtgaaatccgcagatacaggtaagaaggccggtgaagaagttggtctactgggctacagctgacgctgaggtccgaaagccaggggagcgaaccggattagatacccgggtagtcctggctgtaaacgatgctcactaggtgtagggagcgaaagactctctgtgctgaagcgaacgcgataagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctgccgtaaggtgggaggttacacaggtggtgcacggtcgtcgtcagctcgtgccgtgaggtgttgggttaagtcccacaacgagcgcaacccctacaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccgtaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6661 - DNA, 1521 bp, Petrotoga olearia
  ref <308>: DATABASE ACCESSION NUMBER: NCBI ACCESSION: NZ_REFG01000018.1
  ref <309>: DATABASE ENTRY DATE: 2019-04-01
  ref <313>: RELEVANT RESIDUES IN SEQ ID NO: (1)..(1521)
aggatgaagggtttgatcctggctcagggtaaacgctggcggcgtgcgtaacacatgcaagtcggacgggccattactcttcggagtgatggttagtggcgaacgggtgagtaaaaggtagggacctaccccgaggacagagatagctactggaaacggtaggtaaactctgataagcccgagaggggaaagtgggagacagccttgggatggacctactatccatcaggtagttggtgaggtaaaggcttaccaagccgatgacggataaccggtgtgagagcatgtacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataagagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaaggttgctcaacgattggcttgcggatgaaactggttatcttgggcgtagcagaggtagacggaattacctgagtaggggtgaaatccgcagatacaggtaagaacgccggtgaagaagttggtctactgggctacagctgacgctgaggtccgaaagccaggggagcgaaccggattagatacccgggtagtcctggctgtaaacgatgctcactaggtgtagggagcgaaagactctctgtgctgaagcgaacgcgataagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctacaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccgtgaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttggcgaggggggcgaagtcgtaacaaggtaggtgtaccggaaggtgcgcctggatcacctcctttctaaggaga

SEQ ID NO: 6662 - DNA, 1521 bp, Petrotoga sibirica
  ref <308>: DATABASE ACCESSION NUMBER: NCBI ACCESSION: NZ_JAHC01000042.1
  ref <309>: DATABASE ENTRY DATE: 2019-04-01
  ref <313>: RELEVANT RESIDUES IN SEQ ID NO: (1)..(1521)
aggatgaagggtttgatcctggctcagggttaacgctggcggcgtgcgtaacacatgcaagtcgaacgggccattactctttggagtgatggttagtggcgaacgggtgagtaaaaggtagggacctaccccgaggacagagatagctactggaaacggtaggtaaactctgataagcccgagaggggaaagtggaaggcagccttgggatggacctactatccatcaggtagttggtgaggtaaaggctcaccaagccgatgacggataaccggtgtgagagcatgtacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataaaagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaagattgctcaacgattggcttgcggatgaaactggtcatcttgggcgtagcagaggtagacggaattacctgagtaggggtgaaatccgcagatacaggtaagaacgccggtgaagaagttggtctactaggctacagctgacgctgaggtccgaaagccaggggagcgaaccggattagatacccgggtagtcctggctgtaaacgatgctcactaggtgtagggagcgaaagactctctgtgctgaagctaacgcgataagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctgccgtgaggtaggaggttacacaggtggtgcacggtcgtcgtcagctcgtgccgtgaggtgttgggttaagtcccacaacgagcgcaacccctacaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccgagaggtggagcggatccgaaaaaactctccgtaatatggattgtaggctgaaactcgcctacatgaagctggaatcgctagtaatcgcaggtcagccaaactgcggtgaatacgttcccgggccttgtacacaccgcccgtcacgccacccgagttgggaacacctgaaggcagtacggaaggtactgttgaaggtgggcttggcgaggggggcgaagtcgtaacaaggtaggtgtaccggaaggtgcgcctggatcacctcctttctaaggaga

SEQ ID NO: 6663 - DNA, 1523 bp, Petrotoga sp. 9PW.55.5.1
  ref <308>: DATABASE ACCESSION NUMBER: NCBI ACCESSION: NZ_AUPM01000063.1
  ref <309>: DATABASE ENTRY DATE: 2019-04-01
  ref <313>: RELEVANT RESIDUES IN SEQ ID NO: (1)..(1523)
aggatgaagggtttgatcctggctcagggtaaacgctggcggcgtgcgtaacacatgcaagtcgaacggttaagcttatcttcggataaggttaacagtggcgaacgggtgagtaaaaggtagggaccaaccccatggacagagatagctactggaaacggtaggtaaactctgataagcccgagaggggaaagtggaaagcagccaagggacggacctactatccatcaggtagttggtgaaggtaaaggctcaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaaggagtccctcgggatgtaaacttctgaactagtcgaataaagaggtagcggacacgctacaagagaaggtaggctaggaaaagtcccggctaactacgtgccagcagccgcggtaagacgtagggggcgagcgttgcccggaattactgggtgtaaaggggacgtaggcggtaaaccaagtcatatgtgaaaaccatttgctcaacgaaaggcttgcgtatgaaactggagaacttgagtgtagcagaggtagacggaattacctgagtaggggtgaaatccgcagatacaggtaagaaggccggtggagaagtcggtctactgggctacaactgacgctgaggtccgaaagccaggggagcgaaccggattagataccgggtagtcctggccgtaaacgatgctcactaggtgtagggagcgaaagactctctgtgctgaagcgaacgcgataagtgagccacctggggagtacgtccgcaaggatgaaactcaaaggaattgacgggggtccgcacaagcggtggagcatgtggtttaattcgaagctaaccgaagaaccttaccaggggatgacatgtaactgaaggtagagaaatctactagcttaccgcaaggtaagaggttacacaggtggtgcacggtcgtcgtcagctcgtgccgtgaggtgttgggttaagtcccacaacgagcgcaacccctacagttagttgccagcgcgtaaaggcgggcgacactaactggacagccgtcgacgaggcggaggaaggaggggatgacgtcagataagcgtgcccctaatactctgggcgacacacgtgctacaatggggaggacaaagggaagcgaagccggaaggtggagcggatcctaaaaaactctccttaatatggattgtaggctgaaacccgctacatgaagctggaatcgctagtaatcgcaggtcagccaaactgcggtgaatacgttcccgggccttgtacacaccgcccgtcacgccacccgagttgggaacacctgaaggcagcacggcaggtactgttgaaggtgggtctagcgaggggggcgaagtcgtaacaaggtaggtgtaccggaaggtgcgcctggatcacctcctttctaagga

SEQ ID NO: 6664 - DNA, 1524 bp, Petrotoga sp. 9PWA.NaAc.5.4
  ref <308>: DATABASE ACCESSION NUMBER: NCBI ACCESSION: NZ_AZRK01000037.1
  ref <309>: DATABASE ENTRY DATE: 2019-04-01
  ref <313>: RELEVANT RESIDUES IN SEQ ID NO: (1)..(1524)
aggatgaagggtttgatcctggctcagggtaaacgctggcggcgtgcttaacacatgcaagtcgaacgggctggataccgacgtaagttggtaaccagttagtggcgaacgggtgagtaaaaggtagggacctatcctgaggacagagatagctactggaaacggtaggtaaactctgataagcccgagaggggaaagtgaaagacagccttaggagggacttactatccatcaggtagttggttaggtaaaggctgaccaagcctatgacggataaccggtgtgagagcatgtacggtcacaagggcactgagacacgggccctactcctacgggaggcagcagtgaggaatcttggacaatgggcgaaagcctgatccagcgacgccgcgtgaaggaagaagtccttcgggatgtaaacttctgaattagccgaataagagggtagcggatacgctacagaagaaggtaggctaagaaaagtcccggctaactacgtgccagcagccgcggtaagacgtagggggcgagcgttgcccggaattactgggtgtaaagggggcgtaggcggactaagaagtcatctgtgaaaacctattgctcaacgataggcttgcggatgaaactggtagtcttgagtgcaccagaggtagacggaattacctgagtaggggtgaaatccgcagatacaggtaagaaggccggtggagaagtcggtctactggggtgtaacagacgctgaggcccgaaagctaggggagcgaaccggattagatacccgggtagtcctagccgtaaacgatgctcactaggtgtagggagtaataagctctctgtgctgaagcgaacgcgataagtgagccacctggggagtacgttcgcaaggatgaaactcaaaggaattgacgggggtccgcacaagcggtggagcatgtggtttaattcgatggtaaccgaagaaccttaccagggcttgacatgcagatgaaggtagagaaatctactggcttactgagaagtaagagtctgcacaggtggtgcacggccgtcgtcagctcgtgccgtgaggtgttgggttaagtcccacaacgagcgcaacccctgcgattagttgccagcatgtagagatgggcgacactaatcggacagccgccgacgaggcggaggaaggaggggatgacgtcaggtaagcgtgccccttatgctctgggcgacacacgtgctacaatgggacgtacaaaaggaagccaagccggaaggtggagcgaatcccgaaaagcgtcccttaatatggattgtaggctgcaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggtctagcgaggggggcgaagtcgtaacaaggtaggtgtaccggaaggtgcgcctggatcacctcctttcta

SEQ ID NO: 6665 - DNA, 1413 bp, Petrotoga sp. 9T1HF07.CasAA.8.2
  ref <308>: DATABASE ACCESSION NUMBER: NCBI ACCESSION: NZ_AZRI01000019.1
  ref <309>: DATABASE ENTRY DATE: 2019-04-01
  ref <313>: RELEVANT RESIDUES IN SEQ ID NO: (1)..(1413)
gagtaaaaggtagggacctgccctaaggacagagatagctactggaaacggtaggtaaactctgataagcccgagaggggaaagtggtagacagccttaggatggacctactatccatcaggtagttggtgaggtaaaggcttaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaagaagtccctcgggatgtaaacttctgaactaatcgaataaaagggtagtggacacactacagaagaaggtaggttaggaaaagtcccggctaactacgtgccagcagccgcggtaagacgtagggggcgagcgttgcccggaattactgggtgtaaaggggacgtaggcgggtgatcaagtcatctgtgaaaagattgctcaacgatcggcttgcggatgaaactgatcatcttgggcgtagcagaggtagacggaattacctgagtaggggtgaaatccgcagatacaggtaagaacgccggtgaagaagttggtctactgggctacagctgacgctgaggtccgaaagccaggggagcaaaccggattagatacccgggtagtcctggccctaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctgcaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6666 - DNA, 1521 bp, Petrotoga sp. HKA.pet.4.5
  ref <308>: DATABASE ACCESSION NUMBER: NCBI ACCESSION: NZ_JGVM01000019.1
  ref <309>: DATABASE ENTRY DATE: 2019-04-01
  ref <313>: RELEVANT RESIDUES IN SEQ ID NO: (1)..(1521)
aggatgaagggtttgatcctggctcagggttaacgctggcggcgtgcgtaacacatgcaagtcggacgggttatagatcttcggagatataaccagtggcgaacgggtgagtaaaaggtagggacctgccctaaggacagagatagctactggaaacggtagataaactctgataagcccgagaggggaaagtggtagacagccttaggatggacctactatccatcaggtagttggtgaggtaaaggcttaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaagaagtccctcgggatgtaaacttctgaactaatcgaataaaagggtagtggacacactacagaagaaggtaggttaggaaaagtcccggctaactacgtgccagcagccgcggtaagacgtagggggcgagcgttgcccggaattactgggtgtaaaggggacgtaggcgggtgatcaagtcatctgtgaaaagattgctcaacgatcggcttgcggatgaaactgatcatcttgggcgtagcagaggtagacggaattacctgagtaggggtgaaatccgcagatacaggtaagaacgccggtgaagaagttggtctactgggctacagctgacgctgaggtccgaaagccaggggagcaaaccggattagatacccgggtagtcctggccctaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctgcaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6667 - DNA, 1521 bp, Petrotoga sp. HWH.PT.55.6.1
  ref <308>: DATABASE ACCESSION NUMBER: NCBI ACCESSION: NZ_ATNS01000041.1
  ref <309>: DATABASE ENTRY DATE: 2019-04-01
  ref <313>: RELEVANT RESIDUES IN SEQ ID NO: (1)..(1521)
aggatgaagggtttgatcctggctcagggttaacgctggcggcgtgcgtaacacatgcaagtcggacgggttatgcttcttcggaagtataaccagtggcgaacgggtgagtaaaaggtagggacctgccctaaggacagagatagctactggaaacggtaggtaaactctgataagcccgagaggggaaagtggtagacagccttaggatggacctactatccatcaggtagttggtgaggtaaaggcttaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaagaagtccctcgggatgtaaacttctgaactaatcgaataaaagggtagtggacacactacagaagaaggtagattaggaaaagtcccggctaactacgtgccagcagccgcggtaagacgtagggggcgagcgttgcccggaattactgggtgtaaaggggacgtaggcgggtgatcaagtcatctgtgaaaagattgctcaacgatcggcttgcggatgaaactgatcatcttgggcgtagcagaggtagacggaattacctgagtaggggtgaaatccgcagatacaggtaagaacgccggtgaagaagttggtctactgggctacagctgacgctgaggtccgaaagccaggggagcaaaccggattagatacccgggtagtcctggccctaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctgcaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6668 - DNA, 1521 bp, Petrotoga sp. HWHPT.55.6.3
  ref <308>: DATABASE ACCESSION NUMBER: NCBI ACCESSION: NZ_AZRJ01000040.1
  ref <309>: DATABASE ENTRY DATE: 2019-04-01
  ref <313>: RELEVANT RESIDUES IN SEQ ID NO: (1)..(1521)
aggatgaagggtttgatcctggctcagggttaacgctggcggcgtgcgtaacacatgcaagtcggacgggttatagatcttcggagatataaccagtggcgaacgggtgagtaaaaggtagggacctgccctaaggacagagatagctactggaaacggtaggtaaactctgataagcccgagaggggaaagtggtagacagccttaggatggacctactatccatcaggtagttggtgaggtaaaggcttaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaagaagtccctcgggatgtaaacttctgaactaatcgaataaaagggtagtggacacactacagaagaaggtagattaggaaaagtcccggctaactacgtgccagcagccgcggtaagacgtagggggcgagcgttgcccggaattactgggtgtaaaggggacgtaggcgggtgatcaagtcatctgtgaaaagattgctcaacgatcggcttgcggatgaaactgatcatcttgggcgtagcagaggtagacggaattacctgagtaggggtgaaatccgcagatacaggtaagaacgccggtgaagaagttggtctactgggctacagctgacgctgaggtccgaaagccaggggagcaaaccggattagatacccgggtagtcctggccctaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctgcaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6669 - DNA, 1425 bp, Petrotoga sp. SL27
  ref <308>: DATABASE ACCESSION NUMBER: NCBI ACCESSION: NZ_JAIP01000035.1
  ref <309>: DATABASE ENTRY DATE: 2019-04-01
  ref <313>: RELEVANT RESIDUES IN SEQ ID NO: (1)..(1425)
aggatgaagggtttgatcctggctcagggttaacgctggcggcgtgcgtaacacatgcaagtcgaacgggccattactctttggagtgatggttagtggcgaacgggtgagtaaaaggtagggacctaccccgaggacagagatagctactggaaacggtaggtaaactctgataagcccgagaggggaaagtggaaggcagccttgggatggacctactatccatcaggtagttggtgaggtaaaggctcaccaagccgatgacggataaccggtgtgagagcatgtacggtcacaagggcactgagacacgggccctactcctacgggaggcagcagtggggaatattggacaatgggcgaaagcctgatccagcgacgccgcgtgaaggaagaagtccttcgggatgtaaacttctgaactaatcgaataaaagggtagtggacacactacagaagaaggtagattaggaaaagtcccggctaactacgtgccagcagccgcggtaagacgtagggggcgagcgttgcccggaatcactgggtgtaaaggggacgtaggcggatgatcaagtcatctgtgaaaagattgctcaacgattggcttgcggatgaaactggtcatcttgggcgtagcagaggtagacggaattacctgagtaggggtgaaatccgcagatacaggtaagaacgccggtgaagaagttggtctactaggctacagctgacgctgaggtccgaaagccaggggagcgaaccggattagatacccgggtagtcctggctgtaaacgatgctcactaggtgtagggagcgaaagactctctgtgctgaagctaacgcgataagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctgccgtgaggtaggaggttacacaggtggtgcacggtcgtcgtcagctcgtgccgtgaggtgttgggttaagtcccacaacgagcgcaacccctacaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccgagaggtggagcggatccgaaaaaactctccgtaatatggattgtaggctgaaactcgcctacatgaagctggaatcgctagtaatcgcaggtcagccaaactgcggtgaatacgttcccgggccttgtacacaccgcccgtcacgccacccgagttgggaacacctgaaggcagtacgg

SEQ ID NO: 6670 - DNA, 1521 bp, Petrotoga sp. Shatin.DS.tank11.9.2.9.3
  ref <308>: DATABASE ACCESSION NUMBER: NCBI ACCESSION: NZ_JGVT01000009.1
  ref <309>: DATABASE ENTRY DATE: 2019-04-01
  ref <313>: RELEVANT RESIDUES IN SEQ ID NO: (1)..(1521)
aggatgaagggtttgatcctggctcagggttaacgctggcggcgtgcgtaacacatgcaagtcggacgggttatagatcttcggagatataaccagtggcgaacgggtgagtaaaaggtagggacctgccctaaggacagagatagctactggaaacggtagataaactctgataagcccgagaggggaaagtggtagacagccttaggatggacctactatccatcaggtagttggtgaggtaaaggcttaccaagccgatgacggataaccggtgtgagagcatggacggtcacaagggcactgagacacgggccctactcctacgggaggcagcagtggggaatcttggacaatgggcgaaagcctgatccagcgacgccgcgtgaaggaagaagtccctcgggatgtaaacttctgaactaatcgaataaaagggtagtggacacactacagaagaaggtagattaggaaaagtcccggctaactacgtgccagcagccgcggtaagacgtagggggcgagcgttgcccggaattactgggtgtaaaggggacgtaggcgggtgatcaagtcatctgtgaaaagattgctcaacgatcggcttgcggatgaaactgatcatcttgggcgtagcagaggtagacggaattacctgagtaggggtgaaatccgcagatacaggtaagaacgccggtgaagaagttggtctactgggctacagctgacgctgaggtccgaaagccaggggagcaaaccggattagatacccgggtagtcctggccctaaacgatgctcactaggtgtagggagcgaaagactctctgtgctgaagcgaacgcgctaagtgagccacctggggagtacgtccgcaaggatgaaactcaaaggaattgacgggggtccgcacaagcggtggagcatgtggtttaattcgaagctaaccgaagaaccttaccagggattgacatgtaactgaaggtagagaaatctactggcctaccgtaaggtaggaggttacacaggtggtgcacggtcgtcgtcagctcgtgccgtgaggtgttgggttaagtcccacaacgagcgcaacccctgcaattagttaccagcaagtaaagttggggacactaattggacagccgccgacgaggcggaggaaggaggggatgacgtcagataagcgtgccccttatactctgggcgacacacgtgctacaatggggaggacaaagggaagcgaagccggaaggtggagcggatccggaaaaactctccgtaatatggattgtaggctgaaacccgcctacatgaagctggaatcgctagtaatcgcaggtcagccaaactgcggtgaatacgttcccgggccttgtacacaccgcccgtcacgccacccgagttgggaacacctgaaggcagtacggtaggtactgttgaaggtgggcttagcgaggggggcgaagtcgtaacaaggtaggtgtaccggaaggtgcgcctggatcacctcctttctaaggaga

SEQ ID NO: 6671 - DNA, 1469 bp, Phaeobacter inhibens
  ref <308>: DATABASE ACCESSION NUMBER: NCBI ACCESSION: NZ_CP031948.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccagggctcaaccctggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 6672 - DNA, 1465 bp, Phaeobacter italicus; identical to SEQ ID NO: 5959
  ref <308>: DATABASE ACCESSION NUMBER: NCBI ACCESSION: NZ_FOOZ01000033.1
  ref <309>: DATABASE ENTRY DATE: 2019-04-01
  ref <313>: RELEVANT RESIDUES IN SEQ ID NO: (1)..(1465)

SEQ ID NO: 6673 - DNA, 1469 bp, Phaeobacter piscinae
  ref <308>: DATABASE ACCESSION NUMBER: NCBI ACCESSION: NZ_CP010689.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggctttcacttcggtgaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 6674 - DNA, 1471 bp, Phaeobacter porticola
  ref <308>: DATABASE ACCESSION NUMBER: NCBI ACCESSION: NZ_CP016364.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttgtaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaaccttttcggagggggcagcggaccacggtgagctcagcgactggggtgaagtcgtaacaaggtagccgtaggggaacctgcggctggatcacctcctttctaa

SEQ ID NO: 6675 - DNA, 1465 bp, Phaeobacter sp. 11ANDIMAR09
  ref <308>: DATABASE ACCESSION NUMBER: NCBI ACCESSION: NZ_LIKT01000062.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagcctctggaaacggagagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttataaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttctcgcaagagaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcatcaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgctaacttttgaggcagcggaccacggtgggttcagcgactggggtgaagtcgtaacaaggtagccgtaggggaacctgcggctggatcacctcctttctaa

SEQ ID NO: 6676 - DNA, 1469 bp, Phaeobacter sp. 22II1-1F12B
  ref <308>: DATABASE ACCESSION NUMBER: NCBI ACCESSION: NZ_AQQP01000053.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagatcttcggatctagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggattagaaagttgggggtgaaatcccagggctcaaccctggaactgcctccaaaactcctagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaactccagagatggagtgtccacttcggtggcgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatccccaaaaactatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 6677 - DNA, 1469 bp, Phaeobacter sp. CECT 5382
  ref <308>: DATABASE ACCESSION NUMBER: NCBI ACCESSION: NZ_CYSG01000002.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttataaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttctcgcaagagacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaaccagcaatggaggcagcggaccacggtgagctcagcgactggggtgaagtcgtaacaaggtagccgtaggggaacctgcggctggatcacctcctttctaa

SEQ ID NO: 6678 - DNA, 1469 bp, Phaeobacter sp. CECT 7735
  ref <308>: DATABASE ACCESSION NUMBER: NCBI ACCESSION: NZ_CYTW01000009.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacatacctttcggtaaggaatagccactggaaacggtgagtaataccttatacgcccttcgggggaaagatttatcgccgagagattggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggaccattaagttgggggtgaaatcccggggctcaaccccggaactgcctccaaaactgctggtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacccttttgggaggcagcggaccacggtaggatcagcgactggggtgaagtcgtaacaaggtagccgtaggggaacctgcggctggatcacctcctttctaa

SEQ ID NO: 6679 - DNA, 1465 bp, Phaeobacter sp. JL2872
  ref <308>: DATABASE ACCESSION NUMBER: NCBI ACCESSION: NZ_QEOS01000020.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcggaaagttgggggtgaaatcccggggctcaaccccggaactgcctccaaaactatcggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttcacttcggtgaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcaacaatgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 6680 - DNA, 1469 bp, Phaeobacter sp. LSS9
  ref <308>: DATABASE ACCESSION NUMBER: NCBI ACCESSION: NZ_CP031956.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 6681 - DNA, 1469 bp, Phaeobacter sp. S60; identical to SEQ ID NO: 6673
  ref <308>: DATABASE ACCESSION NUMBER: NCBI ACCESSION: NZ_JSWJ01000025.1
  ref <309>: DATABASE ENTRY DATE: 2019-04-01
  ref <313>: RELEVANT RESIDUES IN SEQ ID NO: (1)..(1469)

SEQ ID NO: 6682 - DNA, 1524 bp, Phaeodactylibacter xiamenensis
  ref <308>: DATABASE ACCESSION NUMBER: NCBI ACCESSION: NZ_JPOS01000002.1
  ref <309>: DATABASE ENTRY DATE: 2019-04-01
  ref <313>: RELEVANT RESIDUES IN SEQ ID NO: (1)..(1524)
tactatggagagtttgatcctggctcaggatgaacgctagcgggaggcttaatacatgcaagtcgaggggcagcatgggacttcggtcctgatggcgaccggcgcacgggtgagtaacgcgtacgcaacttgcctccaagcgggggatagccccgggaaactgggattaataccccatagcatcattttatcgcctggtaaaatgattaaagcttaggcgcttggagatgggcgtgcgtgccattagctagttggtaaggtaacggcttaccaaggcgacgatggctagggggcgtgagagcgtggccccccacacgggtactgagacacggacccgactcctacgggaggcagcagtaaggaatattggacaatggaggcaactctgatccagccatcccgcgtgcaggatgacggccctatgggttgtaaactgcttttgcgagggaagaaacggtgctatttatagcattttgacggtacctcgagaataagcaccggctaactccgtgccagcagccgcggtaatacggagggtgcaagcgttatccggaatcactgggtttaaagggtgcgtaggcggcattataagtcagaggtgaaagcccgtcgcttaacgatggaattgcctttgatactgtagtgcttgaatcaagttgaggctggcggaatgtggcatgtagcggtgaaatgcatagatatgccatagaacaccaattgcgaaggcagctggctgggcttgaattgacgctgaggcacgaaagcgtggggagcgaacaggattagataccctggtagtccacgccctaaacgatgtttactcgttctaggcacatgttgtctgggaccaagcgaaagcgttaagtaaaccacctggggagtacgtcggcaacgatgaaactcaaaggaattgacgggggtccgcacaagcggtggagcatgtggtttaattcgatgatacgcgaggaaccttacctaggctagaatgtgagcgctaccctgcgaaagcaggggttccttcgggacgcgaaacaaggtgctgcatggttgtcgtcagctcgtgccgtgaggtgttgggttaagtcccgcaacgagcgcaacccctatttccagttgccagcaataagatggggactctggaaagactgccggcgtaagccgcgaggaaggtggggatgacgtcaaatcatcatggcctttatgcctagggctacacacgtgctacaatggtgcatacagagggtagcgaagccgcgaggtggagccaattccagaaagtgcatcccagttcggattggagtctgcaactcgactccatgaaggtggaatcgctagtaatcgcgcatcagccatggcgcggtgaatacgttcccggaccttgtacacaccgcccgtcaagccatggaagccgggggtacctgaagatggtgaccttacgaggagctatctaaggtaaaaccggtaactagggctaagtcgtaacaaggtagccgtaccggaaggtgcggctggaatacctccttt

SEQ ID NO: 6683 - DNA, 1342 bp, Phaeospirillum fulvum
  ref <308>: DATABASE ACCESSION NUMBER: NCBI ACCESSION: NZ_FNWO01000026.1
  ref <309>: DATABASE ENTRY DATE: 2019-04-01
  ref <313>: RELEVANT RESIDUES IN SEQ ID NO: (1)..(1342)
gctaataccgcatacgcccttagggggaaagatttatcgccgagagattagcccgcgtccgattagctagttggtgaggtaaaagctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgacggggacgatgatgacggtacccgtagaagaagccccggctaacttcgtgccagcagccgcggtaatacgaagggggcaagcgttgttcggaattactgggcgtaaagcgcacgcaggcggcgatccaagtcagaagtgaaagccctgggctcaacccgggaactgcttttgatactgggttgctagaatcacggagagggtaggggaattccgagtgtagaggtgaaattcgtagatattcggaagaacaccagtggcgaaggcgcctacctggccgtcgattgacgctcatgtgcgaaagcgtggggagcaaacaggattagataccctggtagtccacgccgtaaacgatgagtgctagatgttggggtgcatgcacctcagtgtcgaagctaacgcgataagcactccgcctggggagtacggccgcaaggttaaaactcaaaggaattgacgggggcccgcacaagcggtggagcatgtggtttaattcgaagcaacgcgcagaaccttaccagcccttgacatgggggataccggccagagagatttggccttcagttcggctgatccccgcacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggcagccaactcgcgagagtgagctaatccccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagga

SEQ ID NO: 6684 - DNA, 1496 bp, Phaeospirillum molischianum
  ref <308>: DATABASE ACCESSION NUMBER: NCBI ACCESSION: NZ_CAHP01000046.1
  ref <309>: DATABASE ENTRY DATE: 2019-04-01
  ref <313>: RELEVANT RESIDUES IN SEQ ID NO: (1)..(1496)
gaagtcaacttgagagtttgatcctggctcagaacgaacgctggcggcaggcttaacacatgcaagtcgaacgaaggcttcggccttagtggcgcacgggtgagtaacacgtgggaatatacctctcggtggggaataacgtcgggaaactgacgctaataccgcatacgcccttagggggaaagatttatcgccgagagattagcccgcgtccgattagctagttggtgaggtaaaagctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgacggggacgatgatgacggtacccgtagaagaagccccggctaacttcgtgccagcagccgcggtaatacgaagggggcaagcgttgttcggaattactgggcgtaaagcgcacgcaggcggcgatccaagtcagaagtgaaagccctgggctcaacccgggaactgcttttgatactgggttgctagaatcacggagagggtaggggaattccgagtgtagaggtgaaattcgtagatattcggaagaacaccagtggcgaaggcgcctacctggccgtcgattgacgctcatgtgcgaaagcgtggggagcaaacaggattagataccctggtagtccacgccgtaaacgatgagtgctagatgttggggtgcatgcacctcagtgtcgaagctaacgcgataagcactccgcctggggagtacggccgcaaggttaaaactcaaaggaattgacgggggcccgcacaagcggtggagcatgtggtttaattcgaagcaacgcgcagaaccttaccagcccttgacatgggggacatcgaccagagagatttggtcttcagttcggctggtccccgcacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggcagccaactcgcgagagtgagctaatcccaaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagga

SEQ ID NO: 6685 - DNA, 1569 bp, Phascolarctobacterium faecium
  ref <308>: DATABASE ACCESSION NUMBER: NCBI ACCESSION: NZ_AP019004.1
  ref <309>: DATABASE ENTRY DATE: 2019-04-01
  ref <313>: RELEVANT RESIDUES IN SEQ ID NO: (1)..(1569)
tttattggagagtttgatcctggctcaggacgaacgctggcggcgtgcctaacacatgcaagtcgaacggagaattttatttcggtagaattcttagtggcgaacgggtgagtaacgcgtaggcaacctgccctttagacggggacaacattccgaaaggagtgctaataccggatgtgatcatcttgccgcatggcaggatgaagaaagatggcctctacaagtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacattgattgaacgctctagagatagagatttcccttcggggacaagaaaacaggtggtgcatggctgtcgtcagctcgtgtcgtgagatgttgggttaagtcccgcaacgagcgcaacccctatcctatgttaccagcaagtaaagttggggactcatgggagactgccagggacaacctggaggaaggcggggatgacgtcaagtcatcatgccccttatgtcttgggctacacacgtactacaatggtcggaaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgttcccgggccttgtacacaccgcccgtcacaccacgaaagttggtaacacccgaagccggtgaggtaacctattaggagccagccgtctaaggtggggccgatgattggggtgaagtcgtaacaaggtagccgtatcggaaggtgcggctggatcacctcctttctatggaga

SEQ ID NO: 6686 - DNA, 1486 bp, Phenylobacterium deserti
  ref <308>: DATABASE ACCESSION NUMBER: NCBI ACCESSION: NZ_QFYR01000008.1
  ref <309>: DATABASE ENTRY DATE: 2019-04-01
  ref <313>: RELEVANT RESIDUES IN SEQ ID NO: (1)..(1486)
caacctgagagtttgatcctggctcagagcgaacgctggcggcaggcctaacacatgcaagtcgaacggctcttcggagcagtggcggacgggtgagtaacgcgtgggaatgtgccctttggtacggaacaactgagggaaacttcagctaataccgtatgtgccctacgggggaaagatttatcgccattggagcagcccgcgttggattaggtagttggtggggtaatggcccaccaagccgacgatccatagctggtctgagaggatgatcagccacactgggactgagacacggcccagactcctacgggaggcagcagtggggaatcttgcgcaatgggcgaaagcctgacgcagccatgccgcgtgtatgatgaaggtcttaggattgtaaaatactttcaccggggaagataatgacggtacccggagaagaagccccggctaacttcgtgccagcagccgcggtaatacgaagggggctagcgttgctcggaattactgggcgtaaagggcgcgtaggcggatatctaagtcgggggtgaaagcccggggctcaacctcggaattgccttcgatactgggtatcttgagtacgggagaggtgtgtggaactccgagtgtagaggtgaaattcgtagatattcggaagaacaccagtggcgaaggcgacacactggcccgttactgacgctgaggcgcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccacagagatgtggttttcccttcggggaccaggacacaggtgctgcatggctgtcgtcagctcgtgtcgtgagatgttgggttaagtcccgcaacgagcgcaaccctcgccattagttgccatcattaagttgggcactctaatgggaccgccggtggtaagccggaggaaggtggggatgacgtcaagtcctcatggcccttacggggtgggctacacacgtgctacaatggcgactacagagggctgcaaccctgcgaaggtgagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggttttacccgaaggcgatgcgctaaccgcaagggggcagtcgaccacggtagggtcagcgactggggtgaagtcgtaacaaggtagccgtaggggaacctgcggctggatcacctcctttctaagg

SEQ ID NO: 6687 - DNA, 1489 bp, Phenylobacterium hankyongense
  ref <308>: DATABASE ACCESSION NUMBER: NCBI ACCESSION: NZ_QFYP01000001.1
  ref <309>: DATABASE ENTRY DATE: 2019-04-01
  ref <313>: RELEVANT RESIDUES IN SEQ ID NO: (1)..(1489)
tcaacctgagagtttgatcctggctcagagcgaacgctggcggcaggcctaatacatgcaagtcgagcgcaccttcgggtgagcggcggacgggtgagtaacgcgtgggaacgtgccctttggtacggaacaactgagggaaacttcagctaataccgtatgtgcccttcgggggaaagatttatcgccattggagcggcccgcgttggattaggtagttggtgaggtaaaggctcaccaagcctacgatccatagctggtctgagaggatgatcagccacactgggactgagacacggcccagactcctacgggaggcagcagtagggaatcttgcgcaatgggcgaaagcctgacgcagccatgccgcgtgaatgatgaaggtcttaggattgtaaaattctttcaccggggaagataatgacggtacccggagaagaagccccggctaacttcgtgccagcagccgcggtaatacgaagggggctagcgttgctcggaattactgggcgtaaagggcgcgtaggcggatgtctaagttgggggtgaaagcccggggctcaacctcggaatagccttcaatactggatatcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgccctgatcgctggagagatccagttttcccttcggggacagggacacaggtgctgcatggctgtcgtcagctcgtgtcgtgagatgttgggttaagtcccgcaacgagcgcaaccctcgccattagttgccatcattaagttgggcactctaatgggaccgccggtggtaagccggaggaaggtggggatgacgtcaagtcctcatggcccttacggggtgggctacacacgtgctacaatggcgactacagagggttgcaaacctgcgaaggggagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggctttacccgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 6688 - DNA, 1487 bp, Phenylobacterium kunshanense
  ref <308>: DATABASE ACCESSION NUMBER: NCBI ACCESSION: NZ_QFYS01000018.1
  ref <309>: DATABASE ENTRY DATE: 2019-04-01
  ref <313>: RELEVANT RESIDUES IN SEQ ID NO: (1)..(1487)
tcaacctgagagtttgatcctggctcagagcgaacgctggcggcaggcctaacacatgcaagtcgaacggctcttcggagcagtggcggacgggtgagtaacgcgtgggaacgtgccctttggttcggaacaacacagggaaacttgtgctaataccggatgagcccttttggggaaagatttatcgccattggagcggcccgcgttggattaggtagttggtggggtaaaggcctaccaagcctacgatccatagctggtctgagaggatgatcagccacactgggactgagacacggcccagactcctacgggaggcagcagtggggaatcttgcgcaatgggcgaaagcctgacgcagccatgccgcgtgtatgatgaaggtcttaggattgtaaaatactttcaccggggaagataatgacggtacccggagaagaagccccggctaacttcgtgccagcagccgcggtaatacgaagggggctagcgttgctcggaattactgggcgtaaagggcgcgtaggcggacagttaagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgccctgatcgctggagagatccagttttcccttcggggacagggacacaggtgctgcatggctgtcgtcagctcgtgtcgtgagatgttgggttaagtcccgcaacgagcgcaaccctcgccattagttgccatcattaagttgggcactctagtgggactgccggtggtaagccggaggaaggtggggatgacgtcaagtcctcatggcccttacggggtgggctacacacgtgctacaatggcgactacagagggttgcaaccctgcgaaggtgagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaagg

SEQ ID NO: 6689 - DNA, 1490 bp, Phenylobacterium sp. CCH12-B4
  ref <308>: DATABASE ACCESSION NUMBER: NCBI ACCESSION: NZ_LSKE01000209.1
  ref <309>: DATABASE ENTRY DATE: 2019-04-01
  ref <313>: RELEVANT RESIDUES IN SEQ ID NO: (1)..(1490)
tcaacctgagagtttgatcctggctcagagcgaacgctggcggcaggcctaacacatgcaagtcgaacggctcttcggagcagtggcggacgggtgagtaacgcgtgggaacgtgccctttggttcggaacaacacagggaaacttgtgctaataccggatgtgcccttcgggggaaagatttatcgccattggagcggcccgcgttggattaggtagttggtggggtaaaggcccaccaagccgacgatccatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggaagataatgacggtacccggagaagaagccccggctaacttcgtgccagcagccgcggtaatacgaagggggctagcgttgctcggaattactgggcgtaaagggcgcgtaggcggacagtttagtcagaggtaaaagcccagggctcaaccttggaactgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccggagagatccggttttcccttcggggaccaggacacaggtgctgcatggctgtcgtcagctcgtgtcgtgagatgttgggttaagtcccgcaacgagcgcaaccctcgccattagttgccagcattaagttgggcactctagtgggactgccggagctaatccggaggaaggcggggatgacgtcaagtcctcatggcccttacggggtgggctacacacgtgctacaatggcgactacagagggttgcaaccctgcgaaggtgagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcacatcatgggagttggctttacccgaaggcggtgcgctaaccagcaatggaggcagccgaccacggtagggtcagcgactgggatgaagtcgtaacaaggtagccgtaggggaacctgcggctggatcacctcctttctaagga

SEQ ID NO: 6690 - DNA, 1490 bp, Phenylobacterium sp. CCH9-H3; identical to SEQ ID NO: 6689
  ref <308>: DATABASE ACCESSION NUMBER: NCBI ACCESSION: NZ_LSJI01000180.1
  ref <309>: DATABASE ENTRY DATE: 2019-04-01
  ref <313>: RELEVANT RESIDUES IN SEQ ID NO: (1)..(1490)

SEQ ID NO: 6691 - DNA, 1488 bp, Phenylobacterium sp. HYN0004
  ref <308>: DATABASE ACCESSION NUMBER: NCBI ACCESSION: NZ_CP029479.1
  ref <309>: DATABASE ENTRY DATE: 2019-04-01
  ref <313>: RELEVANT RESIDUES IN SEQ ID NO: (1)..(1488)
caacctgagagtttgatcctggctcagagcgaacgctggcggcaggcctaatacatgcaagtcgaacgccccttcgggggagtggcggacgggtgagtaacgcgtgggaacgtgccctttggtacggaacaactgagggaaacttcagctaataccgtatgtgcccttcgggggaaagatttatcgccattggagcggcccgcgttggattagctagttggtggggtaaaggcccaccaaggcgacgatccatagctggtctgagaggatgaccagccacactgggactgagacacggcccagactcctacgggaggcagcagtagggaatcttgggcaatgggcgaaagcctgacccagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagttagaggtgaaagcccagggctcaaccttggaactgcctttgatactggcgatctggagtacgggagaggtgtgtggaactccgagtgtagaggtgaaattcgtagatattcggaagaacaccagtggcgaaggcgacacactggcccgttactgacgctgaggcgcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggttttcccttcggggactaggacacaggtgctgcatggctgtcgtcagctcgtgtcgtgagatgttgggttaagtcccgcaacgagcgcaaccctcgccattagttgccatcattcagttgggcactctaatgggaccgccggtggtaagccggaggaaggtggggatgacgtcaagtcctcatggcccttacaaggtgggctacacacgtgctacaatggcgactacagagggctgcaaccctgcgaaggtgagctaatccccaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggctttacccgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 6692 - DNA, 1485 bp, Phenylobacterium sp. LX32
  ref <308>: DATABASE ACCESSION NUMBER: NCBI ACCESSION: NZ_QFYQ01000001.1
  ref <309>: DATABASE ENTRY DATE: 2019-04-01
  ref <313>: RELEVANT RESIDUES IN SEQ ID NO: (1)..(1485)
caacctgagagtttgatcctggctcagagcgaacgctggcggcaggcctaatacatgcaagtcgaacggctcttcggagcagtggcggacgggtgagtaacgcgtgggaacgtgcccaaaggtacggaacaactgagggaaacttcagctaataccgtatgtgcccttagggggaaagatttatcgcctttggagcggcccgcgttggattaggtagttggtggggtaaaggcctaccaagcctacgatccatagctggtctgagaggatgatcagccacactgggactgagacacggcccagactcctacgggaggcagcagtagggaatcttgcgcaatgggcgaaagcctgacgcagccatgccgcgtgtatgatgaaggtcttaggattgtaaaatactttcaccggggaagataatgacggtacccggagaagaagccccggctaacttcgtgccagcagccgcggtaatacgaagggggctagcgttgctcggaattactgggcgtaaagggcgcgtaggcggatatctaagtcgggggtgaaagcccggggctcaacctcggaattgccttcgatactggatatcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgccctgatcgccacagagatgtggttttcccttcggggacagggacacaggtgctgcatggctgtcgtcagctcgtgtcgtgagatgttgggttaagtcccgcaacgagcgcaaccctcgccattagttgccatcattaagttgggcactctaatgggaccgccggtggtaagccggaggaaggtggggatgacgtcaagtcctcatggcccttacggggtgggctacacacgtgctacaatggcgactacagagggttgcaaacctgcgaaggggagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaag

SEQ ID NO: 6693 - DNA, 1495 bp, Phenylobacterium sp. Root1277
  ref <308>: DATABASE ACCESSION NUMBER: NCBI ACCESSION: NZ_LMDZ01000005.1
  ref <309>: DATABASE ENTRY DATE: 2019-04-01
  ref <313>: RELEVANT RESIDUES IN SEQ ID NO: (1)..(1495)
tcatctcaacctgagagtttgatcctggctcagagcgaacgctggcggcaggcctaatacatgcaagtcgagcggtcccttcgggggcagcggcggacgggtgagtaacgcgtgggaacgtgccctttggtacggaacaactgagggaaacttcagctaataccgtatgtgcccttcgggggaaagatttatcgccattggagcggcccgcgttggattaggtagttggtgaggtaaaggctcaccaagccgacgatccatagctggtctgagaggatgatcagccacactgggactgagacacggcccagactcctacgggaggcagcagtagggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaacccacgccattagttgccatcatttagttgggcactctaatgggaccgccggtggtaagccggaggaaggtgtggatgacgtcaagtcctcatggcccttacagggtgggctacacacgtgctacaatggcgactacagagggttgcaagccagcgatggtgagccaatcccaaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaagga

SEQ ID NO: 6694 - DNA, 1495 bp, Phenylobacterium sp. Root1290; identical to SEQ ID NO: 6693
  ref <308>: DATABASE ACCESSION NUMBER: NCBI ACCESSION: NZ_LMEE01000001.1
  ref <309>: DATABASE ENTRY DATE: 2019-04-01
  ref <313>: RELEVANT RESIDUES IN SEQ ID NO: (1)..(1495)

SEQ ID NO: 6695 - DNA, 1497 bp, Phenylobacterium sp. Root700
  ref <308>: DATABASE ACCESSION NUMBER: NCBI ACCESSION: NZ_LMHT01000001.1
  ref <309>: DATABASE ENTRY DATE: 2019-04-01
  ref <313>: RELEVANT RESIDUES IN SEQ ID NO: (1)..(1497)
tcatctcaacctgagagtttgatcctggctcagagcgaacgctggcggcaggcctaatacatgcaagtcgagcggtcccttcgggggcagcggcggacgggtgagtaacgcgtgggaacgtgccctttggtacggaacaactgagggaaacttcagctaataccgtatgtgcccttcgggggaaagatttatcgccattggagcggcccgcgttggattaggtagttggtgaggtaaaggctcaccaagcctacgatccatagctggtctgagaggatgatcagccacactgggactgagacacggcccagactcctacgggaggcagcagtagggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaacccacgccattagttgccatcattaagttgggcactctaatgggaccgccggtggtaagccggaggaaggtgtggatgacgtcaagtcctcatggcccttacagggtgggctacacacgtgctacaatggcgactacagagggttgcaagccagcgatggtgagccaatcccaaaaagtcgtctcagttcggattgcactctgcaactcgagtgcatgaagtcggaatcgctagtaatcgcggatcagcatgccgcggtgaatacgttcccgggccttgtacacaccgcccgtcacaccatgggagttggttctacccgaaggcgatgcgctaaccagcaatggaggcagtcgaccacggtagggtcagcgactggggtgaagtcgtaacaaggtagccgtaggggaacctgcggctggatcacctcctttctaagga

SEQ ID NO: 6696 - DNA, 1495 bp, Phenylobacterium sp. Root77; identical to SEQ ID NO: 6693
  ref <308>: DATABASE ACCESSION NUMBER: NCBI ACCESSION: NZ_LMIM01000008.1
  ref <309>: DATABASE ENTRY DATE: 2019-04-01
  ref <313>: RELEVANT RESIDUES IN SEQ ID NO: (1)..(1495)

SEQ ID NO: 6697 - DNA, 1490 bp, Phenylobacterium zucineum
  ref <308>: DATABASE ACCESSION NUMBER: NCBI ACCESSION: NC_011144.1
  ref <309>: DATABASE ENTRY DATE: 2019-04-01
  ref <313>: RELEVANT RESIDUES IN SEQ ID NO: (1)..(1490)
tcaacctgagagtttgatcctggctcagagcgaacgctggcggcaggcctaatacatgcaagtcgagcggcccttcggggcagcggcggacgggtgagtaacgcgtgggaatgtgccctttggtacggaacaacacagggaaacttgtgctaataccgtatgtgcccttcgggggaaagatttatcgccattggagcagcccgcgttggattaggtagttggtgaggtaaaggctcaccaagccgacgatccatagctggtctgagaggatgatcagccacactgggactgagacacggcccagactcctacgggaggcagcagtagggaatcttgcgcaatgggcgaaagcctgacgcagccatgccgcgtgaatgatgaaggtcttaggattgtaaaattctttcaccggggaagataatgacggtacccggagaagaagtcccggctaacttcgtgccagcagccgcggtaatacgaagggggctagcgttgctcggaattactgggcgtaaagggcgcgtaggcggatgtttaagtcgggggtgaaagcccggggctcaacctcggaattgccttcgatactggacatcttgagtacgggagaggtgagtggaactccgagtgtagaggtgaaattcgtagatattcggaagaacaccagtggcgaaggcgactcactggcccgttactgacgctgaggcgcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaagggaattgacgggggcccgcacaagcggtggagcatgtggtttaattcgaagcaacgcgcagaaccttaccaccttttgacatgccctgatcgctggagagatccagttttcccttcggggacagggacacaggtgctgcatggctgtcgtcagctcgtgtcgtgagatgttgggttaagtcccgcaacgagcgcaaccctcgccattagttgccatcattaagttgggcactctaatgggaccgccggtggtaagccggaggaaggtggggatgacgtcaagtcctcatggcccttacggggtgggctacacacgtgctacaatggcgactacagagggttgcgatgctgcgaagcggagctaatccctaaaagtcgtctcagttcggattgcactctgcaactcgagtgcatgaagtcggaatcgctagtaatcgcggatcagcatgccgcggtgaatacgttcccgggccttgtacacaccgcccgtcgcaccatgggagttggctttacccgaaggcggtgcgctaaccagcaatggaggcagccgaccacggtagggtcagcgactggggtgaagtcgtaacaaggtagccgtaggggaacctgcggctggatcacctcctttctaagga

SEQ ID NO: 6698 - DNA, 1517 bp, Phocea massiliensis
  ref <308>: DATABASE ACCESSION NUMBER: NCBI ACCESSION: NZ_LT629937.1
  ref <309>: DATABASE ENTRY DATE: 2019-04-01
  ref <313>: RELEVANT RESIDUES IN SEQ ID NO: (1)..(1517)
tttatctaagagtttgatcctggctcaggacgaacgctggcggcgcgcctaacacatgcaagtcgaacgagccgaggggagcttgctccccagagctagtggcggacgggtgagtaacacgtgagcaacctgcctttcagagggggataacgtttggaaacgaacgctaataccgcataacataccgggaccgcatgattctggtatcaaaggagcaatccgctgaaagatgggctcgcgtccgattagctagttggcggggtaacggcccaccaaggcgacgatcggtagccggactgagaggttgatcggccacattgggactgagacacggcccagactcctacgggaggcagcagtgggggatattgcacaatggaggaaactctgatgcagcgacgccgcgtgagggaagacggtcttcggattgtaaacctctgtctttggggacgataatgacggtacccaaggaggaagctccggctaactacgtgccagcagccgcggtaatacgtagggagcgagcgttgtccggaattactgggtgtaaagggagcgtaggcggggtctcaagtcgaatgttaaatctaccggctcaactggtagctgcgttcgaaactggggctcttgagtgaagtagaggcaggcggaattcctagtgtagcggtgaaatgcgtagatattaggaggaacaccagtggcgaaggcggcctgctgggcttttactgacgctgaggctcgaaagcgtggggagcaaacaggattagataccctggtagtccacgccgtaaacgatgattactaggtgtggggggactgaccccttccgtgccggagttaacacaataagtaatccacctggggagtacgaccgcaaggttgaaactcaaaggaattgacgggggcccgcacaagcagtggattatgtggtttaattcgaagcaacgcgaagaaccttaccaggtcttgacatcgagtgacggctctagagatagagctttccttcgggacacaaagacaggtggtgcatggttgtcgtcagctcgtgtcgtgagatgttgggttaagtcccgcaacgagcgcaacccttattattagttgctacattcagttgagcactctaatgagactgccgttgacaaaacggaggaaggtggggatgacgtcaaatcatcatgccccttatgacctgggctacacacgtaatacaatggcgatcaacagagggaagcaagaccgcgaggtggagcaaacccctaaaagtcgtctcagttcggattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcagtagcctaaccgcaaagagggcgctgccgaaggtgggattgatgactggggtgaagtcgtaacaaggtagccgtatcggaaggtgcggctggatcacctcctttcta

SEQ ID NO: 6699 - DNA, 1492 bp, Phormidesmis priestleyi
  ref <308>: DATABASE ACCESSION NUMBER: NCBI ACCESSION: NZ_PVWG01000089.1
  ref <309>: DATABASE ENTRY DATE: 2019-04-01
  ref <313>: RELEVANT RESIDUES IN SEQ ID NO: (1)..(1492)
caacatggagagtttgatcctggctcaggatgaacgctggcggtatgcttaacacatgcaagtcgaacggaatccttcgggatttagtggcggacgggtgagtaacgcgtgagaatctgccttcaggacggggacaacagttggaaacggctgctaaaacccgatgtgcctacgggtgaaatatttatagcctgaagaggagctcgcgtctgattagctagttggtgcggtaacggcgtaccaaggcgacgatcagtaactggtctgagaggatgaccagtcacactgggactgagacacggcccagactcctacgggaggcagcagtggggaattttccgcaatgggcgcaagcctgacggagcaataccgcgtgagggaggaaggctcttgggtcgtaaacctcttttatcagggaagaacacaatgacggtacctgatgaatcagcatcggctaactccgtgccagcagccgcggtaatacggaggatgcaagcgttatccggaattattgggcgtaaagcgtccgcaggtggttttgaaagtttgctgttaaatcgcgaggctcaacttcgtaacggcggtgaaaacttcaagactagagtttggtaggggtcacgggaattcccagtgtagcggtgaaatgcgtagatattgggaagaacaccagcggcgaaagcgcgtgactgggcctgaactgacactcatggacgaaagctaggggagcgaaagggattagatacccctgtagtcctagccgtaaacgatgacaactaggtgttgcccgtatcgacccgggcagtgccgtagccaacgcgttaagttgtccgcctggggagtacgcacgcaagtgtgaaactcaaaggaattgacgggggcccgcacaagcggtggagtatgtggtttaattcgatgcaacgcgaagaaccttaccaaggcttgacatgtgcagaatcctcttgaaagggaggagtgccttcgggagctgcaacacaggtggtgcatggctgtcgtcagctcgtgtcgtgagatgttgggttaagtcccgcaacgagcgcaaccctcgtttctagttgccatcattgagttgggcactttagagagactgccggtgacaaaccggaggaaggtggggatgacgtcaagtcagcatgccccttacgccttgggctacacacgtactacaatgctacggacaaagagccgcaagttcgcgaggacaagcaaatctcataaaccgtggctcagttcagattgcaggctgcaactcgcctgcatgaaggcggaatcgctagtaatcgcaggtcagcatactgcggtgaatacgttcccgggccttgtacacaccgcccgtcacaccatgggagttggccacgcccgaagtcgttactccaaccgttcgcggaggaggatgccgaaggcagggctgatgactggggtgaagtcgtaacaaggtagccgtaccggaaggtgtggctggatcacctcctta

SEQ ID NO: 6700 - DNA, 1499 bp, Phormidium sp. HE10JO
  ref <308>: DATABASE ACCESSION NUMBER: NCBI ACCESSION: NZ_FSSI02000033.1
  ref <309>: DATABASE ENTRY DATE: 2019-04-01
  ref <313>: RELEVANT RESIDUES IN SEQ ID NO: (1)..(1499)
aacacggagagtttgatcctggctcaggatgaacgctggcggcgtgcctaacacatgcaagtcgaacgaagttcttcggaacttagtggcggacgggtgagtaacgcgtgagaatctaccttcaggacggggacaacagctggaaacggctgctaatacccgatatgccgaaaggtgaaaagttatttcgcctggagaggagctcgcgtccgattagctagttggtggggtaaaagcttaccaaggcaacgatcggtagctggtctgagaggatgagcagccacactggaactgagacacggtccagactcctacgggaggcagcagtggggaattttccgcaatgggcgaaagcctgacggagcaacgccgcgtgggggaagaaggtttttggattgtaaaccccttttctcaaggaagaacaaaatgacggtacttgaggaatcagcctcggctaactccgtgccagcagccgcggtaatacggaggaggcaagcgttatccggaattattgggcgtaaagcgttcgtaggcggctgttcaagtctgctgtcaaagaccgaggctcaacctcgggtcggcagtggaaactggatagctagaggtcggtaggggcagagggaattcccagtgtagcggtgaaatgcgtagatattgggaagaacaccggtggcgaaagcgctctgctgggccgaacctgacgctgagggacgaaagctaggggagcgaatgggattagataccccagtagtcctagccgtaaacgatggaaactaggtgtggcctgtatcgacccgggccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgccgcgaatcttgctgaaagggaagagtgcctacgggagcgcggacacaggtggtgcatggctgtcgtcagctcgtgtcgtgagatgttgggttaagtcccgcaacgagcgcaaccctcgtccttagttgccatcattaagttgggcactctagggagactgccggtgataaaccggaggaaggtggggatgacgtcaagtcatcatgccccatatgtcctgggctacacacgtactacaatggtcgggacaacgagcagccaactcgcaagagtgcgctaatctcttaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagttggccatgcccgaagtcgttaccctaaccgttcgcggagggggatgccgaaggcagggctgatgactggggtgaagtcgtaacaaggtagccgtaccggaaggtgtggctggatcacctcctttttaggga

SEQ ID NO: 6701 - DNA, 1490 bp, Phormidium tenue
  ref <308>: DATABASE ACCESSION NUMBER: NCBI ACCESSION: NZ_MRCG01000040.1
  ref <309>: DATABASE ENTRY DATE: 2019-04-01
  ref <313>: RELEVANT RESIDUES IN SEQ ID NO: (1)..(1490)
aacatggagagtttgatcctggctcaggatgaacgctggcggcgtgcttaacacatgcaagtcgaacggacccttcggggttagtggcggacgggtgagtaacgcgtgaggatctgcccttaggaggggaacaacagttggaaacgactgctaatgccccatatgccgagaggtgaaatgttatatcgcctagggatgaactcgcgtctgattagctagttggtggggtaaaggctcaccaaggcgacgatcagtagctggtctaagaggatgatcagccacactgggactgagacacggcccagactcctacgggaggcagcagtggggaattttccgcaatgggcgaaagcctgacggagcaacgccgcgtgagggacgaaggccttagggttgtaaacctcttttctctgggaagaagaactgacggtaccagaggaataagcctcggctaactccgtgccagcagccgcggtaagacggaggaggcaagcgttatccggaattattgggcgtaaagcgtccgcaggcggctaattaagtctgttgtcaaagcccacagctcaactgtggatcggcaatggaaactggttggctagagtgtggtaggggtagagggaattcccggtgtagcggtgaaatgcgtagatatcgggaagaacaccagtggcgaaggcgctctactgggccacaactgacgctgagggacgaaagctaggggagcgaaagggattagatacccctgtagtcctagctgtaaacgatggatactaggtgttggacgtatcgacccgtgcagtaccgtagctaacgcgttaagtatcccgcctggggagtacgcacgcaagtgtgaaactcaaaggaattgacgggggcccgcacaagcggtggaggatgtggtttaattcgatgcaacgcgaagaaccttaccaaggcttgacatgtcacgaatctttgcgagagcagagagtgccttcgggagcgtgaacacaggtggtgcatggctgtcgtcagctcgtgtcgtgagatgttgggttaagtcccgcaacgagcgcaacccacgtttttagttgccatcattaagttgggcactctaaagagactgccgtggacaacacggaggaaggtgtggacgacgtcaagtcatcatgccccttacgtcttgggctacacacgtcctacaatgctacagacagagggcagcgagcgcgcgagtgcaagcaaatcccataaactgtggctcagttcagattgcaggctgcaactcgcctgcatgaaggcggaatcgctagtaatcgcaggtcagcatactgcggtgaatacgttcccgggccttgtacacaccgcccgtcacaccatgggagttggccacgcccgaagtcgttactctaaccgttcgcggaggagggcgccgaaggcagggctgatgactggggtgaagtcgtaacaaggtagccgtaccggaaggtgtggctggatcacctcctttt

SEQ ID NO: 6702 - DNA, 953 bp, Photobacterium angustum
  ref <308>: DATABASE ACCESSION NUMBER: NCBI ACCESSION: NZ_PYOW01000044.1
  ref <309>: DATABASE ENTRY DATE: 2019-04-01
  ref <313>: RELEVANT RESIDUES IN SEQ ID NO: (1)..(953)
tgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgccaactagcgatagtgagcgaatcccagaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6703 - DNA, 1019 bp, Photobacterium aquimaris
  ref <308>: DATABASE ACCESSION NUMBER: NCBI ACCESSION: NZ_FYAH01000036.1
  ref <309>: DATABASE ENTRY DATE: 2019-04-01
  ref <313>: RELEVANT RESIDUES IN SEQ ID NO: (1)..(1019)
actttaattgaagagtttgatcatggctcagattgaacgctggcggcaggcctaacacatgcaagtcgagcggtaacagaaagaaagcttgctttctttgctgacgagcggcggacgggtgagtaatgcctgggaatataccctgatgtgggggataactattggaaacgatagctaataccgcataatctcttcggagcaaagagggggaccttcgggcctctcgcgtcaggattagcccaggtgggattagctagttggtggggtaatggctcaccaaggcaacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcagttaagttaatagcttagctgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctag

SEQ ID NO: 6704 - DNA, 1354 bp, Photobacterium carnosum
  ref <308>: DATABASE ACCESSION NUMBER: NCBI ACCESSION: NZ_NPIB01000062.1
  ref <309>: DATABASE ENTRY DATE: 2019-04-01
  ref <313>: RELEVANT RESIDUES IN SEQ ID NO: (1)..(1354)
ggagcaaagagggggaccttcgggcctctcgcgtcaggattagcccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcgttggagttaatagcttcagcgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaagctagcgatagtgagcgaatcccacaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6705 - DNA, 1566 bp, Photobacterium damselae
  ref <308>: DATABASE ACCESSION NUMBER: NCBI ACCESSION: NZ_UGTD01000001.1
  ref <309>: DATABASE ENTRY DATE: 2019-04-01
  ref <313>: RELEVANT RESIDUES IN SEQ ID NO: (1)..(1566)
taattgaagagtttgatcatggctcagattgaacgctggcggcaggcctaacacatgcaagtcgagcggcagcgacttaactgaaccttcggggaacgttaagggcggcgagcggcggacgggtgagtaatgcctgggaatatgcctcagtgtgggggataactattggaaacgatagctaataccgcataatctccgatcttttatgagatgggagcaaagagggggaccttcgggcctctcgcgctgagattagcccaggtgggattagcttgttggtgaggtaatggctcaccaaggcaacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagtagggaggaaggtagtgtagttaacacctgcattatttgacgttacctacagaagaagcaccggctaactccgtgccagcagccgcggtaatacggagggtgcgagcgttaatcggaattactgggcgtaaagcgcatgcaggcggcctgttaagtcagatgtgaaagcccggggcttaacctcggaattgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaaacttgaagagattcgagtgtgccttcgggaactctgagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggcatatacagagggcagcaagaccgcgaggtggagcgaatcccagaaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6706 - DNA, 1070 bp, Photobacterium iliopiscarium
  ref <308>: DATABASE ACCESSION NUMBER: NCBI ACCESSION: NZ_PYOP01000103.1
  ref <309>: DATABASE ENTRY DATE: 2019-04-01
  ref <313>: RELEVANT RESIDUES IN SEQ ID NO: (1)..(1070)
agcgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaagctagcgatagtgagcgaatcccacaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6707 - DNA, 1184 bp, Photobacterium kishitanii
  ref <308>: DATABASE ACCESSION NUMBER: NCBI ACCESSION: NZ_PYOZ01000049.1
  ref <309>: DATABASE ENTRY DATE: 2019-04-01
  ref <313>: RELEVANT RESIDUES IN SEQ ID NO: (1)..(1184)
tttgctgacgagcggcggacgggtgagtaatgcctgggaatataccctgatgtgggggataactattggaaacgatagctaataccgcataatctcttcggagcaaagagggggaccttcgggcctctcgcgtcaggattagcccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcgttggagttaatagcttcagcgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaagctagcgatagt

SEQ ID NO: 6708 - DNA, 1019 bp, Photobacterium leiognathi
  ref <308>: DATABASE ACCESSION NUMBER: NCBI ACCESSION: NZ_PYNT01000028.1
  ref <309>: DATABASE ENTRY DATE: 2019-04-01
  ref <313>: RELEVANT RESIDUES IN SEQ ID NO: (1)..(1019)
ttaattgaagagtttgatcatggctcagattgaacgctggcggcaggcctaacacatgcaagtcgagcggcagcgacttaactgaaccttcggggaacgttaagggcggcgagcggcggacgggtgagtaatgcctgggaatatgccctgatgtgggggataactattggaaacgatagctaataccgcataatctcttcggagcaaagagggggaccttcgggcctctcgcgtcaggattagcccaggtgggattagcttgttggtgaggtaatggctcaccaaggcaacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagtagggaggaaggcagtgtcgttaatagcggcattgtttgacgttacctacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactt

SEQ ID NO: 6709 - DNA, 1333 bp, Photobacterium phosphoreum
  ref <308>: DATABASE ACCESSION NUMBER: NCBI ACCESSION: NZ_PYMU01000088.1
  ref <309>: DATABASE ENTRY DATE: 2019-04-01
  ref <313>: RELEVANT RESIDUES IN SEQ ID NO: (1)..(1333)
gggcctctcgcgtcaggattagcccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcgttggagttaatagcttcagcgcttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaagctagcgatagtgagcgaatcccacaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6710 - DNA, 1560 bp, Photobacterium sp. BEI 247
  ref <308>: DATABASE ACCESSION NUMBER: NCBI ACCESSION: NZ_RJLM01000057.1
  ref <309>: DATABASE ENTRY DATE: 2019-04-01
  ref <313>: RELEVANT RESIDUES IN SEQ ID NO: (1)..(1560)
ttaattgaagagtttgatcatggctcagattgaacgctggcggcaggcctaacacatgcaagtcgagcggtaacaggaggaaagcttgctttctttgctgacgagcggcggacgggtgagtaatgcctgggaatatgccttgatgtgggggataactattggaaacgatagctaataccgcataatgtccttgttcattacgagcagagaccaaagagggggaccttcgggcctctcgcgtcaagattagcccaggtgggattagctrgttggtggggtaamggctcaccaaggcgacgatccctagctggtctgagaggatgatcagccacactggaactgagacacggtccagactcctacgggaggcagcagtggggaatattgcacaatgggggaaaccctgatgcagccatgcgtgtatgaagaaggccttcgggttgtaaagtactttcagtcgtgaggaaggttgagtagttaayagctgcytamyttgacgttagcgacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagaagagattttggtgtgccttcgggaactctgagacaggtgctgcatggctgtcgtcagctcgtgttgtgaaatgttgggttaagtcccgcaacgagcgcaacccctatccttgtttgccagcacgtaatggtgggaactccagggagactgccggtgataaaccggaggaaggtggggacgacgtcaagtcatcatggcccttacgagtagggctacacacgtgctacaatggcgtatacagagggcggcgagctagcgatagtgagcgaatcccacaaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaccagaagtagatagcttaacccttcggggagggcgtttaccacggtgtggttcatgactggggtgaagtcgtaacaaggtagccctaggggaacctggggctggatcacctcctta

SEQ ID NO: 6711 - DNA, 1140 bp, Photobacterium sp. CECT 9190
  ref <308>: DATABASE ACCESSION NUMBER: NCBI ACCESSION: NZ_FYAK01000035.1
  ref <309>: DATABASE ENTRY DATE: 2019-04-01
  ref <313>: RELEVANT RESIDUES IN SEQ ID NO: (1)..(1140)
actttaattgaagagtttgatcatggctcagattgaacgctggcggcaggcctaacacatgcaagtcgagcggtaacagattgatagcttgctatcaatgctgacgagcggcggacgggtgagtaatgcctgggaatataccctgatgtgggggataactattggaaacgatagctaataccgcataatctcttcggagcaaagagggggaccttcgggcctctcgcgtcaggattagcccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcagttaagttaatagcttagctgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcac

SEQ ID NO: 6712 - DNA, 931 bp, Photobacterium sp. CECT 9192
  ref <308>: DATABASE ACCESSION NUMBER: NCBI ACCESSION: NZ_FYAJ01000043.1
  ref <309>: DATABASE ENTRY DATE: 2019-04-01
  ref <313>: RELEVANT RESIDUES IN SEQ ID NO: (1)..(931)
gtccagactcctacgggaggcagcagtggggaatattgcacaatgggggaaaccctgatgcagccatgccgcgtgtatgaagaaggccttcgggttgtaaagtactttcagttgtgaggaaggcgttaaagttaatagctttagcgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagggatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaa

SEQ ID NO: 6713 - DNA, 530 bp, Photobacterium sp. GB-1
  ref <308>: DATABASE ACCESSION NUMBER: NCBI ACCESSION: NZ_PYOB01000072.1
  ref <309>: DATABASE ENTRY DATE: 2019-04-01
  ref <313>: RELEVANT RESIDUES IN SEQ ID NO: (1)..(530)
cgtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaa

SEQ ID NO: 6714 - DNA, 786 bp, Photobacterium sp. GB-210
  ref <308>: DATABASE ACCESSION NUMBER: NCBI ACCESSION: NZ_PYNU01000060.1
  ref <309>: DATABASE ENTRY DATE: 2019-04-01
  ref <313>: RELEVANT RESIDUES IN SEQ ID NO: (1)..(786)
gtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcca

SEQ ID NO: 6715 - DNA, 674 bp, Photobacterium sp. GB-27
  ref <308>: DATABASE ACCESSION NUMBER: NCBI ACCESSION: NZ_PYNZ01000096.1
  ref <309>: DATABASE ENTRY DATE: 2019-04-01
  ref <313>: RELEVANT RESIDUES IN SEQ ID NO: (1)..(674)
gtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatccttgtttgccagcacataatggtgggaactc

SEQ ID NO: 6716 - DNA, 529 bp, Photobacterium sp. GB-3
  ref <308>: DATABASE ACCESSION NUMBER: NCBI ACCESSION: NZ_PYOA01000075.1
  ref <309>: DATABASE ENTRY DATE: 2019-04-01
  ref <313>: RELEVANT RESIDUES IN SEQ ID NO: (1)..(529)
gtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaa

SEQ ID NO: 6717 - DNA, 659 bp, Photobacterium sp. GB-36
  ref <308>: DATABASE ACCESSION NUMBER: NCBI ACCESSION: NZ_PYNY01000080.1
  ref <309>: DATABASE ENTRY DATE: 2019-04-01
  ref <313>: RELEVANT RESIDUES IN SEQ ID NO: (1)..(659)
cgtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatccttgtttgccagcac

SEQ ID NO: 6718 - DNA, 786 bp, Photobacterium sp. GB-50; identical to SEQ ID NO: 6714
  ref <308>: DATABASE ACCESSION NUMBER: NCBI ACCESSION: NZ_PYNX01000054.1
  ref <309>: DATABASE ENTRY DATE: 2019-04-01
  ref <313>: RELEVANT RESIDUES IN SEQ ID NO: (1)..(786)

SEQ ID NO: 6719 - DNA, 786 bp, Photobacterium sp. GB-56; identical to SEQ ID NO: 6714
  ref <308>: DATABASE ACCESSION NUMBER: NCBI ACCESSION: NZ_PYNW01000052.1
  ref <309>: DATABASE ENTRY DATE: 2019-04-01
  ref <313>: RELEVANT RESIDUES IN SEQ ID NO: (1)..(786)

SEQ ID NO: 6720 - DNA, 787 bp, Photobacterium sp. GB-72
  ref <308>: DATABASE ACCESSION NUMBER: NCBI ACCESSION: NZ_PYNV01000047.1
  ref <309>: DATABASE ENTRY DATE: 2019-04-01
  ref <313>: RELEVANT RESIDUES IN SEQ ID NO: (1)..(787)
cgtttgacgttagcaacagaagaagcaccggctaactccgtgccagcagccgcggtaatacggagggtgcgagcgttaatcggaattactgggcgtaaagcgcatgcaggtggtctgttaagcaagatgtgaaagcccggggctcaacctcggaacagcattttgaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcca

SEQ ID NO: 6721 - DNA, 1319 bp, Photobacterium sp. LAM9072
  ref <308>: DATABASE ACCESSION NUMBER: NCBI ACCESSION: NZ_QZMS01000002.1
  ref <309>: DATABASE ENTRY DATE: 2019-04-01
  ref <313>: RELEVANT RESIDUES IN SEQ ID NO: (1)..(1319)
gattggcccaggtgggattagctagtaggtggggtaacggctcacctaggcgacgatccctagctggtctgagaggatgatcagccacactggaactgagacacggtccagactcctacgggaggcagcagtggggaatattgcacaatggggggaaccctgatgcagccatgccgcgtgtgtgaagaaggccttcgggttgtaaagcactttcagcagtgaggaagaggtggtgtttaatagatgccatctttgacgttagctgcagaagaagcaccggctaactccgtgccagcagccgcggtaatacggagggtgcgagcgttaatcggaattactgggcgtaaagcgcatgcaggcggcgtgttaagccagatgtgaaagcccggggctcaacctcggaatcgcatttggaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttggaggttggtgtcttgaacactggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggcgtatacagagggcggcgagctagcgatagtgagcgaatcccacaaagtacgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttacct

SEQ ID NO: 6722 - DNA, 1067 bp, Photobacterium sp. NCIMB 13483
  ref <308>: DATABASE ACCESSION NUMBER: NCBI ACCESSION: NZ_PYLV01000051.1
  ref <309>: DATABASE ENTRY DATE: 2019-04-01
  ref <313>: RELEVANT RESIDUES IN SEQ ID NO: (1)..(1067)
gtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggctgcaagctagcgatagtgagcgaatcccacaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 6723 - DNA, 908 bp, Photobacterium toruni
  ref <308>: DATABASE ACCESSION NUMBER: NCBI ACCESSION: NZ_FUWP01000087.1
  ref <309>: DATABASE ENTRY DATE: 2019-04-01
  ref <313>: RELEVANT RESIDUES IN SEQ ID NO: (1)..(908)
gattagcccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtatgaagaaggccttcgggttgtaaagtactttcagttgtgaggaaggcagttaagttaatagcttagctgtttgacgttagcaacagaagaagcaccggctaactccgtgccagcagccgcggtaatacggagggtgcgagcgttaatcggaattactgggcgtaaagcgcatgcaggcggtctgttaagcaagatgtgaaagcccggggctcaacctcggaacagcattttgaactggcagactagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttgaaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatccttgtttgccagcac

SEQ ID NO: 6724 - DNA, 1548 bp, Photorhabdus asymbiotica
  ref <308>: DATABASE ACCESSION NUMBER: NCBI ACCESSION: NZ_RBLJ01000002.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgagcggtaacaggaaagtgcttgcacttttgctgacgagcggcggacgggtgagtaatgtctggggatctgcccgagggcgggggataaccactggaaacggtggctaataccgcatgatgtcgcgagaccaaagtgggggacctgaaagggcctcacgccctcggatgaacccagatgggattagctagtaggtagggtaatggcctacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagcaggccttcgggttgtaaagtactttcagcggggaggaagggtttggcctgaagagggttaaattttgacgttacccgcagaagaagcaccggctaactccgtgccagcagccgcggtaatacggagggtgcaagcgttaatcggaatgactgggcgtaaagcgcacgcaggcggtcaattaagttagatgtgaaatccccgggctcaacctgggaatggcatctaagactggttggctagagtctcgtagaggggggtagaattccatgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtggcctagagctgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaagacctcagagatgaggttgtgccttcgggagctctgagacaggtgctgcatggctgtcgtcagctcgtgttgtgaaatgttgggttaagtcccgcaacgagcgcaacccttatcctttgttgccagcacgttgaggtgggaactcaaaggagactgccggtgataaaccggaggaaggtggggatgacgtcaagtcatcatggccctgacgagtagggctacacacgtgctacaatggcggatacaaagtgaagcgacctcgcgagagcaagcggaacacacaaagtctgtcgtagtccggattggagtctgcaactcgactccatgaagtcggaatcgctagtaatcgtagatcagcatgctacggtgaatacgttcccgggccttgtacacaccgcccgtcacaccatgggagtgggtggcaaaagaagtcggtagcctaaccgcgaggggggcgctgaccactttgtgattcatgactggggtgaagtcgtaacaaggtaaccgtaggggaacctgcggttggatcacctccttacct

SEQ ID NO: 6725 - DNA, 1554 bp, Photorhabdus laumondii
  ref <308>: DATABASE ACCESSION NUMBER: NCBI ACCESSION: NZ_CP024901.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgggcggtaacaggaaagcgcttgcgcttttgctgacgagcggcggacgggtgagtaatgtctggggatctgcccgagggcgggggataaccactggaaacggtggctaataccgcataatgtcgcgagaccaaagtgggggacctgaaagggcctcacgccgtcggatgaacccagatgggattagctggtaggtagggtaatggcctacctaggcgacgatctctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaagggtttagcctgaagagggttagattttgacgttacccgcagaagaagcaccggctaactccgtgccagcagccgcggtaatacggagggtgcaagcgttaatcggaatgactgggcgtaaagcgcacgcaggcggtcaattaagttagatgtgaaatccccgggctcaacctgggaatggcatctaagactggttgactggagtctcgtagaggggggtagaattccatgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgcggtcttgaacggtggcttccgaagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatttgctggagacagcgaagtgccttagggaactgagagacaggtgctgcatggctgtcgtcagctcgtgttgtgaaatgttgggttaagtcccgcaacgagcgcaacccttatcctttgttgccagcacgtgaaggtgggaactcaaaggagactgccggtgataaaccggaggaaggtggggatgacgtcaagtcatcatggcccttacgagtagggctacacacgtgctacaatggcggatacaaagtgaagcgacctcgcgagagcaagcggaacacacaaagtctgtcgtagtccggattggagtctgcaactcgactccatgaagtcggaatcgctagtaatcgtagatcagcatgctacggtgaatacgttcccgggccttgtacacaccgcccgtcacaccatgggagtgggttgcaaaagaagtcggtagcttaaccgaaaggggggcgctgaccactttgtggctcatgactggggtgaagtcgtaacaaggtaaccgtaggggaacctgcggttggatcacctccttacctgagaga

SEQ ID NO: 6726 - DNA, 858 bp, Photorhabdus namnaonensis
  ref <308>: DATABASE ACCESSION NUMBER: NCBI ACCESSION: NZ_LOIC01000041.1
  ref <309>: DATABASE ENTRY DATE: 2019-04-01
  ref <313>: RELEVANT RESIDUES IN SEQ ID NO: (1)..(858)
gggggataaccactggaaacggtggctaataccgcataatgtcgcaagaccaaagtgggggacctgaaagggcctcacgccgtcggatgaacccagatgggattagctggtaggtagggtaatggcctacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggatgtaacttgaatagagttggattttgacgttacccgcagaagaagcaccggctaactccgtgccagcagccgcggtaatacggagggtgcaagcgttaatcggaatgactgggcgtaaagcgcacgcaggcggtcaattaagttagatgtgaaatccccgggctcaacctgggaatggcatctaagactggttgactggagtctcgtagaggggggtagaattccatgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtggccttgagctgtggcttccgaagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcc

SEQ ID NO: 6727 - DNA, 1611 bp, Photorhabdus sp. CRCIA-P01
  ref <308>: DATABASE ACCESSION NUMBER: NCBI ACCESSION: NZ_NMQR01000158.1
  ref <309>: DATABASE ENTRY DATE: 2019-04-01
  ref <313>: RELEVANT RESIDUES IN SEQ ID NO: (1)..(1611)
agctgtaacgtgagtttatggccaatctcaaaaaaacagtctcagttcggattgaagtctgcaactcgacttcatgaagttggaatcgctagtaatcgcgaatcagcatgtcgctggcggcgcgcctaatacatgcaagtcgaacggaaaccttagggttttagtggcgaacgggtgagtaacacgtaagcaacctgcctttaagacgtggataacaattggaaacagttgctaagacaggataggaaattaagaggcatcttttaatttttaaaagacctttttcgaaaggtatacttaaagaggggcttgcgccacattagttagttggtaaggtaaaagcttaccaagacgatgatgtgtagctggactgagaggtcgaacagccacattgggactgagacacggcccaaactcctacgggaggcagcagtaaggaatttttggcaatggaggaaactctgaccgagcgacgccgcgtgaacaatgaagtacttcggtatgtaaagttcttttattgaaaaagaaaaaatagtggaaaaactatcttgacattattcaatgaataagccccggctaattatgtgccagcagccgcggtaatacataaggggcgagcgttatccggaattattgggcgtaaagggtgcgtaggcggtttgataagtctatagtttaaatgcagtgcttaacgctgtagcgctatagaaactgtctgactagagttagatagaggcaagcggaattccatgtgtagcggtaaaatgcgtaaatatatggaggaacaccagaggcgtaggcggcttgctgggtcttaactgacgctgaggcacgaaagcgtggggagcaaacaggattagataccctggtagtccacgccgtaaacgatgagtactaagtgtcgggtttcgactcggtactgaagttaacacattaagtactccgcctgagtagtacgtacgcaagtatgaaacttaaaggaattgacgggaccccgcacaagcggtggatcatgttgtttaattcgaagatacacgaaaaaccttaccaggtcttgacataattttgcgacattatagaaatataatgaaggttatcagaattacaggtggtgcatggttgtcgtcagctcgtgtcgtgagatgttaggttaagtcctaaaacgagcgcaacccttgtcgttagttgcgaccacgtaatggtgagtactttagcgagactgccaatgaaaaattggaggaaggtgaggattacgtcaaatcatcatgccccttatgatctgggctacaaacgtgatacaatggctgttacaaagagtagctgtaacgtgagtttatggccaatctcaaaaaaacagtctcagttcggattgaagtctgcaactcgacttcatgaagttggaatcgctagtaatcgcgaatcagcatgtcgcggtgaatacgttctcggggtttgtacacaccgcccgtcaaaccacgaaagttgataatacccgaaagcggtcgcctaacttcgttagaagagggagccgtctaaggtaggatcgatgattggggttaagtcgtaacaaggtatccctaccggaaggtggggatggatcacctcctttct

SEQ ID NO: 6728 - DNA, 1484 bp, Phreatobacter cathodiphilus
  ref <308>: DATABASE ACCESSION NUMBER: NCBI ACCESSION: NZ_CP027668.1
  ref <309>: DATABASE ENTRY DATE: 2019-04-01
  ref <313>: RELEVANT RESIDUES IN SEQ ID NO: (1)..(1484)
tcaacttgagagtttgatcctggctcagaacgaacgctggcggcaggcttaacacatgcaagtcgagcgccccgcaaggggagcggcagacgggtgagtaacgcgtgggaacgtgccctttggttcggaacaactccgggaaactggagctaataccggataagcccttcgggggaaagatttatcgccaaaggatcggcccgcgtctgattagctagttggtggggtaatggcccaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgttcggaatcactgggcgtaaagcgcacgtaggcggacttttaagtcaggggtgaaatcctggagctcaactccagaactgcctttgatactgggagtctcgagtgtggaagaggttggtggaactgcgagtgtagaggtgaaattcgtagatattcgcaagaacaccagtggcgaaggcggccaactggtccattactgacgctgaggtgcgaaagcgtggggagcaaacaggattagataccctggtagtccacgccgtaaacgatgaatgccagccgttggggagcttgctcctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagctcttgacatcccgtgttacatcgagagatcgatggtcctcttcggaggcgcggagacaggtgctgcatggctgtcgtcagctcgtgtcgtgagatgttgggttaagtcccgcaacgagcgcaaccctcgcctttagttgccagcattcagttgggcactctagagggactgccggtgataagccggaggaaggtggggatgacgtcaagtcctcatggcccttacgggctgggctacacacgtgctacaatggcggtgacagtgggcagcaaatccgcaaggacaagctaatctccaaaagccgtctcagttcggattgcactctgcaactcgagtgcatgaagttggaatcgctagtaatcgcagatcagaatgctgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccgtaggggaacctgcggctggatcacctcctttcta

SEQ ID NO: 6729 - DNA, 1483 bp, Phreatobacter oligotrophus
  ref <308>: DATABASE ACCESSION NUMBER: NCBI ACCESSION: NZ_PZZL01000041.1
  ref <309>: DATABASE ENTRY DATE: 2019-04-01
  ref <313>: RELEVANT RESIDUES IN SEQ ID NO: (1)..(1483)
caacttgagagtttgatcctggctcagaacgaacgctggcggcaggcttaacacatgcaagtcgagcgccccgcaaggggagcggcagacgggtgagtaacgcgtgggaacgtaccttttggttcggaacaactccgggaaactggagctaataccggataagcccttcgggggaaagatttatcgccgaaagatcggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgttcggaatcactgggcgtaaagcgcacgtaggcggaccattaagtcaggggtgaaagcctggagctcaactccagaactgcctttgatactgatggtctcgagttcggaagaggttggtggaactgcgagtgtagaggtgaaattcgtagatattcgcaagaacaccagtggcgaaggcggccaactggtccgatactgacgctgaggtgcgaaagcgtggggagcaaacaggattagataccctggtagtccacgccgtaaacgatgaatgccagccgttggggagcttgctcctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagctcttgacatcccgtgccacgcccagagatgggcggtcctcttcggaggcgcggagacaggtgctgcatggctgtcgtcagctcgtgtcgtgagatgttgggttaagtcccgcaacgagcgcaaccctcgcctttagttgccagcattcagttgggcactctagagggactgccggtgataagccggaggaaggtggggatgacgtcaagtcctcatggcccttacgggctgggctacacacgtgctacaatggcggtgacagtgggcagcaaagccgcaaggccaagctaatctccaaaagccgtctcagttcggattgcactctgcaactcgagtgcatgaagttggaatcgctagtaatcgcagatcagaatgctgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccgtaggggaacctgcggctggatcacctcctttcta

SEQ ID NO: 6730 - DNA, 1526 bp, Phycicoccus sp. CMS6Z-2
  ref <308>: DATABASE ACCESSION NUMBER: NCBI ACCESSION: NZ_SAYU01000054.1
  ref <309>: DATABASE ENTRY DATE: 2019-04-01
  ref <313>: RELEVANT RESIDUES IN SEQ ID NO: (1)..(1526)
acggagagtttgatcctggctcaggacgaacgctggcggcgtgcttaacacatgcaagtcgaacggtgaaggacggagcttgctccgaccggatcagtggcgaacgggtgagtaacacgtgagtaacctgccccagactctggaataaccccgggaaaccggagctaataccggatacgagacggagaggcatctctaccgtctggaaagtttttcggtctgggatggactcgcggcctatcagctagttggtgaggtaaaggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggaagaagcgaaagtgacggtacctgtagaagaagcaccggctaactacgtgccagcagccgcggtaatacgtagggtgcgagcgttgtccggaattattgggcgtaaagagcttgtaggcggtctgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcgtggggagcgaacaggattagataccctggtagtccacgccgtaaacgttgggaactaggtgtgggtctcattccacgagatccgtgccgcagctaacgcattaagttccccgcctggggagtacggccgcaaggctaaaactcaaaggaattgacgggggcccgcacaagcggcggagcatgtggattaattcgatgcaacgcgaagaaccttaccaaggcttgacatatacgagaacgcgtcagagatgacgttctctttggacactcgtatacaggtggtgcatggttgtcgtcagctcgtgtcgtgagatgttgggttaagtcccgcaacgagcgcaaccctcgttctatgttgccagcgcgtcatggcggggactcatagaagactgccggggtcaactcggaggaaggtggggacgacgtcaaatcatcatgccccttatgtcttgggcttcacacatgctacaatggccggtacagagggctgcgaaaccgtaaggtggagcgaatcccaaaaagccggtctcagttcggattggggtctgcaactcgaccccatgaagtcggagtcgctagtaatcgtagatcagcaacgctacggtgaatacgttcccgggccttgtacacaccgcccgtcaagtcacgaaagtcggtaacacccgaagccggtggcccaactctttgagagggagccgtcgaaggtgggactggcgattgggactaagtcgtaacaaggtagccgtaccggaaggtgcggctggatcacctcctttcta

SEQ ID NO: 6731 - DNA, 1498 bp, Phyllobacteriaceae bacterium SYSU D60010
  ref <308>: DATABASE ACCESSION NUMBER: NCBI ACCESSION: NZ_QORU01000011.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcaggcttaacacatgcaagtcgaacgggtgtagcaatacatcagtggcagacgggtgagtaacacgtgggaaccttcctcgttgtacggaacaactcagggaaacttgagctaataccgtatacgtccgagaggagaaagatttatcgcaatgagacgggcccgcgtcggattagctagttggtggggtaatggcctaccaaggcgacgatccgtagctgatctgagaggatgatcagccacactgggactgagacacggcccagactcctacgggaggcagcagtggggaatcttggacaatgggcgcaagcctgatccagccatgccgcgtgagtgaagaaggccttagggttgtaaagctcttttgccagggacgataatgacggtacctggagaataagccccggcaaacttcgtgccagcagccgcggtaatacgaagggggctagcgttgttcggatttactgggcgtaaagcgcacgtaggcgggtcgttaagtcaggggtgaaatcccggagctcaactccggaactgcctttgatactggcgaccttgaggctggaagaggttagtggaattcccagtgtagaggtgaaattcgtagatattgggaagaacaccagtggcgaaggcggctaactggtccagatctgacgctgaggtgcgaaagcgtggggagcaaacaggattagataccctggtagtccacgccgtaaactatgggtgctagctgtcagcgggcttgctcgttggtggcgcagctaacgcattaagcaccccgcctggggagtacggtcgcaagattaaaacttaaaggaattgacgggggcccgcacaagcggtggagcatgtggtttaattcgaagcaacgcgcagaaccttaccaacccttgacatcccggtcgcggacaccagagatggagtccttcagttcggctggaccggagacaggtgctgcatggctgtcgtcagctcgtgtcgtgagatgttgggttaagtcccgcaacgagcgcaaccctcgcctttagttgccatcatttagttgggcactctaaagggactgccggtgataagccggaggaaggtggggatgacgtcaagtcctcatggcccttacgggttgggctacacacgtgctacaatggcggtgacagtgggcagctacttcgcaaggagaagctaatcccaaaaagccgtctcagttcagattgcactctgcaactcgggtgcatgaagttggaatcgctagtaatcgctaatcagcaggtagcggtgaatacgttcccgggccttgtacacaccgcccgtcacaccatgggagttggtcttacctgaagacggtgtgctaaccagcaatggaggcagccggccacggtaaggtcagcgactggggtgaagtcgtaacaaggtagccgtaggggaacctgcggctggatcacctcctttctaagg

SEQ ID NO: 6732 - DNA, 1498 bp, Phyllobacteriaceae bacterium SYSU D60012
  ref <308>: DATABASE ACCESSION NUMBER: NCBI ACCESSION: NZ_QOZQ01000016.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcaggcttaacacatgcaagtcgagcgggtgtagcaatacatcagcggcagacgggtgagtaacacgtgggaaccttcctcgttgtacggaacaactcagggaaacttgagctaataccgtatacgtccgagaggagaaagatttatcgcaatgagacgggcccgcgtcggattagctagttggtggggtaacggcctaccaaggcgacgatccgtagctgatctgagaggatgatcagccacactgggactgagacacggcccagactcctacgggaggcagcagtggggaatcttggacaatgggcgcaagcctgatccagccatgccgcgtgagtgaagaaggccttagggttgtaaagctcttttgccagggacgataatgacggtacctggagaataagccccggcaaacttcgtgccagcagccgcggtaatacgaagggggctagcgttgttcggatttactgggcgtaaagcgcacgtaggcgggtcgttaagtcaggggtgaaatcccggagctcaactccggaactgcctttgatactggcgaccttgaggctggaagaggttagtggaattcccagtgtagaggtgaaattcgtagatattgggaagaacaccagtggcgaaggcggctaactggtccagatctgacgctgaggtgcgaaagcgtggggagcaaacaggattagataccctggtagtccacgccgtaaactatgggtgctagctgtcagcgggcttgctcgttggtggcgcagctaacgcattaagcaccccgcctggggagtacggtcgcaagattaaaacttaaaggaattgacgggggcccgcacaagcggtggagcatgtggtttaattcgaagcaacgcgcagaaccttaccaacccttgacatcccggtcgcggacaccagagatggagtccttcagttcggctggaccggagacaggtgctgcatggctgtcgtcagctcgtgtcgtgagatgttgggttaagtcccgcaacgagcgcaaccctcgcctttagttgccatcatttagttgggcactctaaagggactgccggtgataagccggaggaaggtggggatgacgtcaagtcctcatggcccttacgggttgggctacacacgtgctacaatggcggtgacagagggcagctacttcgcaaggagaagctaatccctaaaagccgtctcagttcagattgcactctgcaactcgggtgcatgaagttggaatcgctagtaatcgctaatcagcaggtagcggtgaatacgttcccgggccttgtacacaccgcccgtcacaccatgggagttggtcttacctgaagacggtgtgctaaccagcaatggaggcagccggccacggtaaggtcagcgactggggtgaagtcgtaacaaggtagccgtaggggaacctgcggctggatcacctcctttctaagg

SEQ ID NO: 6733 - DNA, 1491 bp, Phyllobacteriaceae bacterium StC1
  ref <308>: DATABASE ACCESSION NUMBER: NCBI ACCESSION: NZ_QFWV02000004.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccttcgggggagtggcagacgggtgagtaacgcgtgggaatctacccagctctacggaataactgagggaaacttcagctaataccgtatacgtccttcgggagaaagatttatcggagttggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcgcgtaggcggattgatcagtcaggggtgaaatcccggggctcaaccccggaactgcctttgatactgtcaatctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcgggcagtatactgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggtttccagagatggattccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaag

SEQ ID NO: 6734 - DNA, 1522 bp, Phyllobacteriaceae bacterium Water-Bin73
  ref <308>: DATABASE ACCESSION NUMBER: NCBI ACCESSION: NZ_FZLQ01000008.1
  ref <309>: DATABASE ENTRY DATE: 2019-04-01
  ref <313>: RELEVANT RESIDUES IN SEQ ID NO: (1)..(1522)
aaacttgagagtttgatcctggctcagaacgaacgctggcggcaggcctaacacatgcaagtcgaacgagaagcttcttcggaagtggacagtggcagacgggtgagtaacgcgtggggatctgcccagaggttcggaacaaccattggaaacgatggctaataccggataagcccctagggggaaagatttattgcctttggatgaacccgcgtaagattagctagttggtgaggtaatggctcaccaaggcgacgatctttagctggtctgagaggatgatcagccacattgggactgagacacggcccagactcctacgggaggcagcagtggggaatattgcgcaatgggcgaaagcctgacgcagccatgccgcgtgtgtgaagaaggccttagggttgtaaagcactttcaattgggaggaaaagttaacgactaatactcgttagccttgacgttacctttagaagaagcaccggctaactccgtgccagcagccgcggtaatacggagggtgcaagcgttaatcggaattactgggcgtaaagcgcgcgtaggcggctttttaagtcggatgtgaaagccccgggctcaacctgggaactgcatccgatactggaaggctagagtgcgagagagggaggtagaattccatgtgtagcggtgaaatgcgtagatatgtggaggaataccagtggcgaaggcggcctcctggctcgacactgacactgaggtgcgaaagcgtggggagcaaacaggattagataccctggtagtccacgccgtaaacgatgtctactagccgttgggagacttgatctcttagtggcgcagttaacgcgataagtagaccgcctggggagtacggccgcaaggttaaaactcaaatgaattgacgggggcccgcacaagcggtggagcatgtggtttaattcgatgcaacgcgaagaaccttaccaggccttgacatcctaggaatcctgtagagatacgggagtgccttcgggaatctagtgacaggtgctgcatggctgtcgtcagctcgtgtcgtgagatgttgggttaagtcccgtaacgagcgcaacccttgtccttagttgccagcacattatggtgggaactctaaggagactgccggtgacaaaccggaggaaggtggggacgacgtcaagtcatcatggcccttacggcctgggctacacacgtgctacaatggcaagtacagacggctgcaaacccgcgagggggagccaatccgagaaaacttgtcgtagtccggatcgaagtctgcaactcgacttcgtgaagtcggaatcgctagtaatcgcgaatcagaatgtcgcggtgaatacgttcccgggccttgtacacaccgcccgtcacaccatgggagtgggttgctccagaagtaattagtctaaccttcgggagggcgattaccacggagtgattcatgactggggtgaagtcgtaacaaggtagccctaggggaacctggggctggatcacctccttaaac

SEQ ID NO: 6735 - DNA, 1494 bp, Phyllobacteriaceae bacterium Z3-1
  ref <308>: DATABASE ACCESSION NUMBER: NCBI ACCESSION: NZ_RBVY01000014.1
  ref <309>: DATABASE ENTRY DATE: 2019-04-01
  ref <313>: RELEVANT RESIDUES IN SEQ ID NO: (1)..(1494)
tcaacatgagagtttgatcctggctcagaacgaacgctggcggcaggcttaacacatgcaagtcgagcgcactcttcggagtgagcggcagacgggtgagtaacgcgtgggaatctacccagctctacggaataactcagggaaacttgtgctaataccgtatacgtcctccgggagaaagatttatcggagttggatgagcccgcgttgcattagctagttggtggggtaatggcccaccaaggcgacgatgcatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcggtcagttaggggtgaaatcccggggctcaaccccggaactgcctctaatactgccgatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcggcaggtttacctgtcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgtggtttccagagatggattccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagatcgcgaggtcgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaa

SEQ ID NO: 6736 - DNA, 1491 bp, Phyllobacterium brassicacearum
  ref <308>: DATABASE ACCESSION NUMBER: NCBI ACCESSION: NZ_PGGO01000056.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctacccttttctacggaacaactgagggaaacttcagctaataccgtatacggccgagaggcgaaagatttatcggagaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtatccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 6737 - DNA, 1495 bp, Phyllobacterium endophyticum
  ref <308>: DATABASE ACCESSION NUMBER: NCBI ACCESSION: NZ_PGGN01000009.1
  ref <309>: DATABASE ENTRY DATE: 2019-04-01
  ref <313>: RELEVANT RESIDUES IN SEQ ID NO: (1)..(1495)
tcaacttgagagtttgatcctggctcagaacgaacgctggcggcaggcttaacacatgcaagtcgaacggtctcttcggaggcagtggcagacgggtgagtaacgcgtgggaatctacccttttctacggaacaactgagggaaacttcagctaataccgtatacggcctatgggcgaaagatttatcggagaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgtgtgatgaaggtcttaggattgtaaagcactttcaccggtgaagataatgacggtaaccggagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtatccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaacccgcaagggaggcaggcaaccacggtagggtcagcgactggggtgaagtcgtaacaaggtagccgtaggggaacctgcggctggatcacctcctttctaag

SEQ ID NO: 6738 - DNA, 1491 bp, Phyllobacterium leguminum
  ref <308>: DATABASE ACCESSION NUMBER: NCBI ACCESSION: NZ_QJTF01000046.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgagcgcgtagcaatacgagcggcagacgggtgagtaacgcgtgggaatctacccatcactacggaacaactccgggaaactggagctaataccgtatacgaccgagaggtgaaagatttatcggtgatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcgggttccagagatgggacccttcagttaggctggaccggtgacaggtgctgcatggctgtcgtcagctcgtgtcgtgagatgttgggttaagtcccgcaacgagcgcaaccttcgcccctagttgccagcattcagttgggcactctagggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgcgctaaccgcaaggaggcaggcaaccacggtagggtcagcgactggggtgaagtcgtaacaaggtagccgtaggggaacctgcggctggatcacctcctttctaag

SEQ ID NO: 6739 - DNA, 1491 bp, Phyllobacterium sophorae
  ref <308>: DATABASE ACCESSION NUMBER: NCBI ACCESSION: NZ_PGGM01000034.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaatctacccttttctacggaacaactgagggaaacttcagctaataccgtatacggccgagaggcgaaagatttatcggagaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtatccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 6740 - DNA, 1493 bp, Phyllobacterium sp. 1N-3
  ref <308>: DATABASE ACCESSION NUMBER: NCBI ACCESSION: NZ_PVBR01000053.1
  ref <309>: DATABASE ENTRY DATE: 2019-04-01
  ref <313>: RELEVANT RESIDUES IN SEQ ID NO: (1)..(1493)
tcaacatgagagtttgatcctggctcagaacgaacgctggcggcaggcttaacacatgcaagtcgagcgccctcttcggagggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacatttaagtcaggggtgaaatcccggggctcaaccccggaactgcctttgatactgggtgtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttaggctggatcggtgacaggtgctgcatggctgtcgtcagctcgtgtcgtgagatgttgggttaagtcccgcaacgagcgcaaccctcgcccctagttgccagcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgggtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 6741 - DNA, 1496 bp, Phyllobacterium sp. UNC302MFCol5.2
  ref <308>: DATABASE ACCESSION NUMBER: NCBI ACCESSION: NZ_JMLL01000009.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcgtagcaatacgagcggcagacgggtgagtaacgcgtgggaatctaccccttactacggaataacgcagggaaacttgtgctaataccgtatgtggccgagaggcgaaagatttatcggtaagggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagccaacgcattaagctctccgcctggggagtacggtcgcaagattaaaactcaaaggaattgacgggggcccgcacaagcggtggagcatgtggtttaattcgaagcaacgcgcagaaccttaccagcccttgacatgtccgtgaccggtcgcagagatgtgactttctcttcggagcacggagcacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaaggaagcg

SEQ ID NO: 6742 - DNA, 1493 bp, Phyllobacterium sp. YR531
  ref <308>: DATABASE ACCESSION NUMBER: NCBI ACCESSION: NZ_AKIZ01000031.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgaacgccccgcaaggggagtggcagacgggtgagtaacgcgtgggaatctacccaattcttcggaacaacacatggaaacgtgtgctaataccgaatgagcccttcgggggaaagatttatcggaattggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggtcttaggattgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagttcgagagaggtgagtggaattgcgagtgtagaggtgaaattcgtagatattcgcaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagcaaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtttccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 6743 - DNA, 1491 bp, Phyllobacterium zundukense
  ref <308>: DATABASE ACCESSION NUMBER: NCBI ACCESSION: NZ_CP017940.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaacaactgagggaaacttcagctaataccgtatacggcctttgggcgaaagatttatcggagaaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggtcttaggattgtaaagctctttcaccggtgaagataatgacggtaaccggagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcgggcagtatactgttcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtatccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagaatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 6744 - DNA, 1534 bp, Phytoactinopolyspora endophytica
  ref <308>: DATABASE ACCESSION NUMBER: NCBI ACCESSION: NZ_RZHA01001776.1
  ref <309>: DATABASE ENTRY DATE: 2019-04-01
  ref <313>: RELEVANT RESIDUES IN SEQ ID NO: (1)..(1534)
ttaatggagagtttgatcctggctcaggacgaacgctggcggcgtgctttacacatgcaagtcgagcggaaaggccccttcgggggtactcgagcggcgaacgggtgagtaacacgtgggtaacctgcccttagctctgggataagcccgggaaactgggtctaataccggatatgacacatgatcgcatgatccgtgtgtggaaagtttttcggctagggatgggcccgcggcctatcagcttgttggtggggtagtggcctaccaaggcgacgacgggtagccggcctgagagggcgaccggccacactgggactgagacacggcccagactcctacgggaggcagcagtggggaatattgcacaatgggcgaaagcctgatgcagcaacgccgcgtgagggatgacggccttcgggttgtaaacctctttcagcgctgacgaagccttcgggtgactgtaggcgcagaagaagcaccggctaactacgtgccagcagccgcggtaatacgtagggtgcgagcgttgtccggaattattgggcgtaaagggctcgtaggcggcgtgttacgtctgtcgtgaaagctcggggcttaaccccgggtttgcggtggatacgggcatgctagagtccggcaggggagactggaattcctggtgtagcggtgaaatgcgcagatatcaggaggaacaccggtggcgaaggcgggtctctgggccggaactgacgctgaggagcgaaagcgtggggagcgaacaggattagataccctggtagtccacgccgtaaacgttgggcgctaggtgtgggtccttttccatagggtccgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacacggaaatccggcagagatgtcgggtcctttaaagggtcgtgtacaggtggtgcatggctgtcgtcagctcgtgtcgtgagatgttgggttaagtcccgcaacgagcgcaacccttatcctatgttgccagcacgttatggtggggactcataggagactgccggggtcaactcggaggaaggtggggatgacgtcaagtcatcatgccccttatgtccagggcttcacgcatgctacaatggccggtacaaagggttgcgatactgtgaggtggagcgaatcccaaaaagccggtctcagttcggatcggggtctgcaactcgaccccgtgaagttggagtcgctagtaatcgtagatcagcaacgctgcggtgaatacgttctcgggccttgtacacaccgcccgtcacgtcatgaaagtcggtaacacccgaagcccatggcctaacccctttgggggagggagtggtcgaaggtgggactggcgattaggacgaagtcgtaacaaggtagccgtaccggaaggtgcggctggatcacctcctttctaaggagc

SEQ ID NO: 6745 - DNA, 1552 bp, Phytobacter sp. SCO41
  ref <308>: DATABASE ACCESSION NUMBER: NCBI ACCESSION: NZ_CP027225.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcagtacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 6746 - DNA, 1552 bp, Phytobacter ursingii
  ref <308>: DATABASE ACCESSION NUMBER: NCBI ACCESSION: NZ_CP011602.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcaggagggcgcttaccactttgtgattcatgactggggtgaagtcgtaacaaggtaaccgtaggggaacctgcggttggatcacctccttaccttaaagaa

SEQ ID NO: 6747 - DNA, 1537 bp, Pigmentiphaga sp. H8
  ref <308>: DATABASE ACCESSION NUMBER: NCBI ACCESSION: NZ_CP033966.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcggcatgccttacacatgcaagtcgaacggcagcgcggacttcggtctggcggcgagtggcgaacgggtgagtaatgcatcggaacgtgcccagtagcgggggataactacgcgaaagcgtagctaataccgcatacgccctacgggggaaagggggggatcgcaagacctctcactattggagcggccgatgtcggattagctagttggtggggtaaaggcctaccaaggcaacgatccgtagctggtttgagaggacgaccagccacactgggactgagacacggcccagactcctacgggaggcagcagtggggaattttggacaatgggggcaaccctgatccagccatgccgcgtgtgcgaagaaggccttcgggttgtaaagcacttttggcaggaaagaaacggcgccggataatacctggcgtaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggctcaaccttggaactgcatttttaactcccgaactagagtgtgtcagaggggggtggaattccacgtgtagcagtgaaatgcgtagatatgtggaggaacaccgatggcgaaggcagccccctgggataacactgacgctcatgcacgaaagcgtggggagcaaacaggattagataccctggtagtccacgccctaaacgatgtcaactagctgttgggttcttcggagcttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgaaagagaaccggaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggcttcacacgtcatacaatggtcgggacagagggcagccaacccgcgagggggagccaatcccagaaacccgatcgtagtccggattgcagtctgcaactcgactgcatgaagtcggaatcgctagtaatcgcggatcagcatgtcgcggtgaatacgttcccgggtcttgtacacaccgcccgtcacaccatgggagtgggttctaccagaagtaggtagcctaaccgtaaggagggcgcttaccacggtagggttcatgactggggtgaagtcgtaacaaggtagccgtatcggaaggtgcggctggatcacctcctttc

SEQ ID NO: 6748 - DNA, 1537 bp, Pigmentiphaga sp. IMT-318
  ref <308>: DATABASE ACCESSION NUMBER: NCBI ACCESSION: NZ_UWPJ01000021.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctagcggcatgccttacacatgcaagtcgaacggcagcgcggacttcggtctggcggcgagtggcgaacgggtgagtaacgcatcggaatgtacccagtagcgggggataactacgcgaaagcgtggctaataccgcatacgccctacgggggaaagggggggatcttcggacctctcactattggagcagccgatgtcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatgccgcgtgtgcgaagaaggccttcgggttgtaaagcacttttggcgggaaagaaacggcgccggataatacctggcgtaactgacggtacccgcagaataagcaccggctaactacgtgccagcagccgcggtaatacgtagggtgcaagcgttaatcggaattactgggcgtaaagcgtgcgcaggcggttcggaaagaaagatgtgaaatcccagggctcaaccttggaactgcatttttaactcccgaactagagtatgtcagaggggggtggaattccacgtgtagcagtgaaatgcgtagatatgtggaggaacaccgatggcgaaggcagccccctgggataatactgacgctcatgcacgaaagcgtggggagcaaacaggattagataccctggtagtccacgccctaaacgatgtcaactagctgttgggttcttcgggacttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgaaagagaaccggaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggcttcacacgtcatacaatggtcgggacagagggcagccaacccgcgagggggagccaatcccagaaacccgatcgtagtccggattgcagtctgcaactcgactgcatgaagtcggaatcgctagtaatcgcggatcagcatgtcgcggtgaatacgttcccgggtcttgtacacaccgcccgtcacaccatgggagtgggttctaccagaagtaggtagcctaaccgtaaggagggcgcttaccacggtagggttcatgactggggtgaagtcgtaacaaggtagccgtatcggaaggtgcggctggatcacctcctttc

SEQ ID NO: 6749 - DNA, 1525 bp, Pirellula staleyi
  ref <308>: DATABASE ACCESSION NUMBER: NCBI ACCESSION: NC_013720.1
  ref <309>: DATABASE ENTRY DATE: 2019-04-01
  ref <313>: RELEVANT RESIDUES IN SEQ ID NO: (1)..(1525)
caattgaagagtttgatcctggctcagaatgaacgttggcggcatggattaggcatgcaagtcgtgcgcgatatgtagcaatacatggagagcggcgaaagggagagtaatacgtaggaacctaccttcgggtctgggatagcggcgggaaactgccggtaataccagatgatgtttccgaaccaaaggtgtgattccgcctgaagaggggcctacgtcgtattagctagttggtagggtaatggcctaccaaggcaaagatgcgtatggggtgtgagagcatgcccccactcactgggactgagacactgcccagacacctacgggtggctgcagtcgagaatcttcggcaatgggcgaaagcctgaccgagcgatgccgcgtgcgggatgaaggccttcgggttgtaaaccgctgtcgtaggggatgaagtgctagggggttctccctctagtttgactgaacctaggaggaagggccggctaatctcgtgccagcagccgcggtaatacgagaggcccaaacgttattcggatttactgggcttaaagagttcgtaggcggtcttgtaagtggggtgtgaaatccctcggctcaaccgaggaactgcgctccaaactacaagacttgagggggatagaggtaagcggaactgatggtggagcggtgaaatgcgttgatatcatcaggaacaccggaggcgaaggcggcttactgggtcctttctgacgctgaggaacgaaagctaggggagcaaacgggattagataccccggtagtcctagccgtaaacgatgagcactggaccggagctctgcacagggtttcggtcgtagcgaaagtgttaagtgctccgcctggggagtatggtcgcaaggctgaaactcaaaggaattgacgggggctcacacaagcggtggaggatgtggcttaattcgaggctacgcgaagaaccttatcctagtcttgacatgcttaggaatcttcctgaaagggaggagtgctcgcaagagagcctttgcacaggtgctgcatggctgtcgtcagctcgtgtcgtgagatgtcgggttaagtcccttaacgagcgaaacccttgtccttagttaccagcgcgtcatggcggggactctaaggagactgccggtgttaaaccggaggaaggtggggatgacgtcaagtcctcatggcctttatgattagggctgcacacgtcctacaatggtgcacacaaagcgacgcaaactcgtgagagccagctaatcgcaaaaaatgtacctcagttcggattgcaggctgcaactcgcctgcatgaagctggaatcgctagtaatcgcgggtcagcataccgcggtgaatgtgttcctgagccttgtacacaccgcccgtcaagccacgaaagtgggggggacccaacagcgctgccgtaaccgcaaggaacaaggcgcctaaggtcaactccgtgattgggactaagtcgtaacaaggtagccgtaggggaacctgcggctggatcacctcctttcta

SEQ ID NO: 6750 - DNA, 433 bp, Pisciglobus halotolerans
  ref <308>: DATABASE ACCESSION NUMBER: NCBI ACCESSION: NZ_FOQE01000061.1
  ref <309>: DATABASE ENTRY DATE: 2019-04-01
  ref <313>: RELEVANT RESIDUES IN SEQ ID NO: (1)..(433)
ttttatgagagtttgatcctggctcaggacgaacgctggcggcgtgcctaatacatgcaagtcgaacgcttttatctcaccgggtgcttgcacccaccgagataaaggagtggcggacgggtgagtaacacgtgggtaacctgcccataagtgggggataacattcggaaacggatgctaataccgcatatctctattggcctcatggccaagtgatgaaaggcggcttcggctgtcgcttatggatggacccgcggcgcattagttagttggtgaggtaacggctcaccaagacgatgatgcgtagccgacctgagagggtgatcggccacactgggactgagacacggcccagactcctacgggaggcagcagtagggaatcttccgcaatggacgaaagtctgacggagcaacgccgcgtgagtgaagaa

SEQ ID NO: 6751 - DNA, 1554 bp, Piscinibacter defluvii; identical to SEQ ID NO: 2739
  ref <308>: DATABASE ACCESSION NUMBER: NCBI ACCESSION: NZ_RCHJ01000063.1
  ref <309>: DATABASE ENTRY DATE: 2019-04-01
  ref <313>: RELEVANT RESIDUES IN SEQ ID NO: (1)..(1554)

SEQ ID NO: 6752 - DNA, 1552 bp, Piscirickettsia salmonis
  ref <308>: DATABASE ACCESSION NUMBER: NCBI ACCESSION: NZ_CP033937.1
  ref <309>: DATABASE ENTRY DATE: 2019-04-01
  ref <313>: RELEVANT RESIDUES IN SEQ ID NO: (1)..(1552)
aagattaaactgaagagtttgatcctggctcagattgaacgctggtggcatgcttaacacatgcaagtcgaacggtagcagatctagcttgctagatgctgacgagtggcggacgggtgagtaacgcgtgggaatttaccttttagtgggggataactttaggaaactgaagctaataccgcataagacctgagggttaaagagggcctctatatataagctcttgctaggagatgagcccgcgttggattagctagttggtagggtaaaggcttaccaaggcgacgatccatagctggtttgagagaatggccagccacactgggactgagacacggcccagactcctacgggaggcagcagtggggaatattggacaatgggggaaaccctgatccagcaatgccacgtgtgtgaagaaggccttagggttgtaaagcactttcagcggggaggaaggtaagctaattaatacttggcttaattgacgttacctgcagaagaagcaccggctaactccgtgccagcagccgcggtaatacggagggtgcgagcgttaatcggaattactgggcgtaaagggcgcgtaggcggaagattaagttggatgtgaaatcccagggctcaaccttggaactgcatccgaaactggtattctagagtatggtagaggaaagtggaatttcaggtgtagcggtgaaatgcgtagatatctgaaggaacaccggtggcgaaggcgactttctggatcaatactgacgctgaggcgcgaaagcatgggtagcgaacaggattagataccctggtagtccatgctgtaaacgatgtcaactagccgttggattcccttgaggagtttagtggcgtagctaacgcgataagttgaccgcctggggagtacggccgcaaggttaaaactcaaaggaattgacgggggcccgcacaagcggtggagcatgtggtttaattcgatgcaacgcgaagaaccttacctggtcttgacatcctaagaagttgatagagatattgatgtgccttcgggagcttagagacaggtgctgcatggctgtcgtcagctcgtgtcgtgagatgttgggttaagtcccgcaacgagcgcaacccttatccttagttgccagcacgtgaaggtgggaactctagggagactgccggtgataaaccggaggaaggtggggacgacgtcaagtcatcatggcccttacgaccagggctacacacgtgctacaatggggcgtacagacggaggcgaagcagcgatgtggagcgaacctgagaaagcgcctcgtagtccggattggagtctgcaactcgactccatgaagtcggaatcgctagtaatcgcgaatcagcatgtcgcggtgaatacgttcccgggccttgtacacaccgcccgtcacaccatgggagtgaattgcaccagaaggggctaggctaactttagggaggccggtcaccacggtgtggttcatgactggggtgaagtcgtaacaaggtagccgtaggggaacctgcggctggattacctccttat

SEQ ID NO: 6753 - DNA, 1552 bp, Piscirickettsiaceae bacterium NZ-RLO2; identical to SEQ ID NO: 6752
  ref <308>: DATABASE ACCESSION NUMBER: NCBI ACCESSION: NZ_QBEV01000376.1
  ref <309>: DATABASE ENTRY DATE: 2019-04-01
  ref <313>: RELEVANT RESIDUES IN SEQ ID NO: (1)..(1552)

SEQ ID NO: 6754 - DNA, 1516 bp, Planctomicrobium piriforme
  ref <308>: DATABASE ACCESSION NUMBER: NCBI ACCESSION: NZ_FOQD01000035.1
  ref <309>: DATABASE ENTRY DATE: 2019-04-01
  ref <313>: RELEVANT RESIDUES IN SEQ ID NO: (1)..(1516)
tcaattgaagggtttgatcctggctcagaatgaacgttggtagcatggattaggcatgcaagtcgagcgacaaggtaccttcgggtactggaggagcggcaaacggggtagtaaggcatcggaacgtaccctcttgtccgggatagccgcgggaaactgcggttaataccggataatcccgaaagggcaaaggtccgccgcgggaggagcggccgatgtgatatcaggtagttggcggggtaacggcccaccaagccatagacgtctaggggatgtgagagcatgatccccaccactgggactgagatactgcccagacacctacgggtggctgcagtcgagaatcttcggcaatgggcgcaagcctgaccgagcgatgctacgtgtgggatgaaggcccttgggttgtaaaccactgtcagaggggatgaaagcgtaagcttgacagagcctcagaggaagcgcgggctaagttcgtgccagcagccgcggtaatacgaactgcgcaaacgttattcggaatcactgggcttacagggtgcgtaggctgccattcaggtccgatgtgaaatcccacagctcaactgtggaatggcattggaaaccgattggcttgagtgagctagagatgcacggaacttccggtggagcggtgaaatgtgttgagatcggaaggaacaccagaggcgaaggcggtgcattggggcttgtctgacgctgaggcacgaaagccaggggagcgaacgggattagataccccggtagtcctggctgtaaacgatcagtactagacggaggggggcttgcccttctcggtcgtagcgaaagcgataagtactgcgcctggggagtatggtcgcaaggctgaaactcaaaggaattgacgggggctcacacaagcggtggagcatgtggcttaattcgaggcaacgcgaagaaccttatcctaggcttgacatgctggaattagttggctgaaaggtcaatgacgccttcgggtggaatcagcacaggtgctgcatggctgtcgtcagctcgtgccgtgaggtgtcgggttaagtccttaaacgagcgaaacccctgtcgtcagttgccagcattcagttggggactctgacgagaccgccggtgtcaaaccggaggaaggcggggacgacgtcaagtcatcatggcctttatgtctagggctgcacacgtgctacaatgcggcgtacaaagggaagccaacccgcgagggggagccaatcccaaaaagcgtcgctcagttcggattgcaggctgcaactcgcctgcatgaagctggaatcgctagtaatcgcaggtcagctatactgcggtgaatgtgttcctgagccttgtacacaccgcccgtcaagccacgaaaggggggggcatcccaagtcgccgagcgaaccgcaaggacgcaggcgcctaagatgaactccctgattgggactaagtcgtaacaaggtagccgtaggggaacctgcggctggatcacctcctttctaaggaa

SEQ ID NO: 6755 - DNA, 1474 bp, Planktotalea frisia
  ref <308>: DATABASE ACCESSION NUMBER: NCBI ACCESSION: NZ_QKZM01000021.1
  ref <309>: DATABASE ENTRY DATE: 2019-04-01
  ref <313>: RELEVANT RESIDUES IN SEQ ID NO: (1)..(1474)
tcaacttgagagtttgatcctggctcagaacgaacgctggcggcaggcctaacacatgcaagtcgagcgcttaccttcgggtaggagcggcggacgggttagtaacgcgtgggaatatacccttcactacggaatagcctcgggaaactgagagtaataccgtatacgcccttcgggggaaagatttatcggtgaaggattagcccgcgtaagattagatagttggtggggtaatggcctaccaagtctacgatctttagctggttttagaggatgatcagcaacactgggactgagacacggcccagactcctacgggaggcagcagtggggaatcttggacaatgggcgcaagcctgatccagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagctaggctggacgagatacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 6756 - DNA, 1500 bp, Planktothricoides sp. SR001
  ref <308>: DATABASE ACCESSION NUMBER: NCBI ACCESSION: NZ_LIUQ01000113.1
  ref <309>: DATABASE ENTRY DATE: 2019-04-01
  ref <313>: RELEVANT RESIDUES IN SEQ ID NO: (1)..(1500)
ttcaacatggagagtttgatcctggctcaggatgaacgctggcggtctgcttaacacatgcaagtcgaacggaatccttcgggatttagtggcggacgggtgagtaacacgtgagaatctgcactcaggatggggacaacagcgggaaactgctgctaatacccaatgtgccgaaaggtaaaagatttatcgcctgagaatgagctcgcggccgattagttagttggtggggtaatggcctaccaagacggcgatcggtagctggtctgagaggatgagcagccacactgggactgagacacggcccagactcctacgggaggcagcagtggggaattttccgcaatgggcgcaagcctgacggagcaagaccgcgtgggggaggaaggctcttgggttgtaaaccccttttctcagggaagaagttctgacggtacctgaggaatcagcctcggctaactccgtgccagcagccgcggtaatacggaggaggcaagcgttatccggaattattgggcgtaaagcgtccgtaggtggtggggcaagtcggcggttaaagactggggcttaactccagaaaggccgtggaaactgcaccactagagggcagtaggggtagagggaattcccggtgtagcggtgaaatgcgtagagatcgggaagaacaccagtggcgaaagcgctctactggactgcaactgacactcagggacgaaagctaggggagcgaatgggattagataccccagtagtcctagccgtaaacgatggatactaggtgttgtctgtatcgacccagacagtgccgcagctaacgcgataagtatcccgcctggggagtacgcacgcaagtgtgaaactcaaaggaattgacgggggcccgcacaagcggtggagtatgtggtttaattcgatgcaacgcgaaaaaccttaccagggcttgacatgtcgcgaacctcgctgaaaggtgagggtgccttcgggagcgcgaacacaggtggtgcatggctgtcgtcagctcgtgtcgtgagatgttgggttaagtcccgcaacgagcgcaaccctcgttcttagttgccatcattcagttgggcactctagggagactgccggtgataaaccggaggaaggtggggatgacgtcaagtcatcatgccccttacgtcctgggctacacacgtactacaatgggtgggacaaagggcagcgaactcgcaagagccagctaatcccataaacccatcctcagttcagattgctctctgcaactcgagagcatgaaggaggaatcgctagtaatcgcaggtcagcatactgcggtgaatacgttcccgggccttgtacacaccgcccgtcacaccatggaagttggccatgcccgaagtcattactctaacccctcggggaggaggatgccgaaggcagggctgatgactggggtgaagtcgtaacaaggtagccgtaccggaaggtgtggctggatcacctcctttttaggga

SEQ ID NO: 6757 - DNA, 1510 bp, Planktothrix agardhii
  ref <308>: DATABASE ACCESSION NUMBER: NCBI ACCESSION: NZ_CM002803.1
  ref <309>: DATABASE ENTRY DATE: 2019-04-01
  ref <313>: RELEVANT RESIDUES IN SEQ ID NO: (1)..(1510)
aaaacggagagtttgatcctggctcaggatgaacgctggcggtctgcttaacacatgcaagtcgaacggaatccttagggatttagtggcggacgggtgagtaacacgtaagaacctgcctctaggacggggacaacagttggaaacgactgctaaacccggatgagccgaaaggtaaaagattaatcgcctagagaggggcttgcgtctgattagctagttggtgaggtaagagcccaccaaggcgacgatcagtagctggtctgagaggatgatcagccacactgggactgagacacggcccagactcctacgggaggcagcagtggggaattttccgcaatgggcgaaagcctgacggagcaagaccgcgtgggggaggaaggttcttggattgtcaaccccttttctcagggaagaacacaatgacggtacctgaggaaaaagcatcggctaactccgtgccagcagccgcggtaatacgggggaatgcaagcgttatccggaatgattggggcgaaaagagtccgtaggtagtcatccaagtctgctgttaaaagagcgaggcttaacctcgtaaaggcagtggaaactggaagactagagtgtagtaggggcagagggaattcctggtgtagcggtgaaatgcgtagagatcaggaagaacaccggtggcgaaggctgctctgctgggctataactgacactgagggacgaaagctaggggagcgatatgggattagataccccagtagtcctagcggtaaactcagatggaaactaggtgtggcctgtatcgacctcgggccgtgcacgaagcaaacgcgttaagtttcccgcctggggagtacgcacgcaagtgtgaaactcaaaggaattgacgggggcccgcacaagcggtggagtatgtggtttaattcgatgcaacgcgaagaaccttaccaggacttgacatctctggaatctccttgaaaggggagagtgccgtaaggaaccgagaagacaggtgctgcatgactgtcgtcagctcgtgtcgtgagatgttgggattaagtcccgcaacgagccgcaaccctcgtcgttagttgcccatcattaagttgggaactctagcgagactgccggtgacaaaccggaggaacgggaggatgacgtcaagtcagcatggcccttacgtcctgcgcgacacacatactacatatgcgagggacacagagcagccaacccgcgagggagagcgaatctcacaaaccctggcacagttcagattgcaggctgcaactcgcctgcatgaaggaggaatcgctagtaatcgcaggtcagcatactgcggtgaatccgttcccgggccttgtacacaccgcccgtcacaccatggaagtgagccacgcccgaagtcattactctaaccctttcgggggaggagggtgccgaaggcggggttgatgactgggggtgaagtcgtaacaaggtagccgtaccggaaggtgtggctggatcacctcctttt

SEQ ID NO: 6758 - DNA, 1492 bp, Planktothrix prolifica
  ref <308>: DATABASE ACCESSION NUMBER: NCBI ACCESSION: NZ_KE734738.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtctgcttaacacatgcaagtcgaacggaatccttcgggatttagtggcggacgggtgagtaacacgtaagaacctgcctctaggacggggacaacagttggaaacgactgctaaacccggatgagccgaaaggtaaaagattaatcgcctagagaggggcttgcgtctgattagctagttggtgaggtaagagcccaccaaggcgacgatcagtagctggtctgagaggatgatcagccacactgggactgagacacggcccagactcctacgggaggcagcagtggggaattttccgcaatgggcgaaagcctgacggagcaagaccgcgtgggggaggaaggttcttggattgtcaaccccttttctcagggaagaacacaatgacggtacctgaggaaaaagcatcggctaactccgtgccagcagccgcggtaatacgggggatgcaagcgttatccggaatgattgggcgtaaagagtccgtaggtagtcatccaagtctgctgttaaagagcgaggcttaacctcgtaaaggcagtggaaactggaagactagagtgtagtaggggcagagggaattcctggtgtagcggtgaaatgcgtagagatcaggaagaacaccggtggcgaaggcgctctgctgggctataactgacactgagggacgaaagctaggggagcgaatgggattagataccccagtagtcctagcggtaaacgatggaaactaggtgtggcctgtatcgacccgggccgtgccgaagcaaacgcgttaagtttcccgcctggggagtacgcacgcaagtgtgaaactcaaaggaattgacgggggcccgcacaagcggtggagtatgtggtttaattcgatgcaacgcgaagaaccttaccaggacttgacatctctggaatctccttgaaaggggagagtgccgtaaggaaccagaagacaggtgctgcatggctgtcgtcagctcgtgtcgtgagatgttgggttaagtcccgcaacgagcgcaaccctcgtcgttagttgccatcattaagttgggaactctagcgagactgccggtgacaaaccggaggaaggtgaggatgacgtcaagtcagcatggcccttacgtcctgggcgacacacgtactacaatgcgagggacagagagcagccaacccgcgagggagagcgaatctcataaaccctggcacagttcagattgcaggctgcaactcgcctgcatgaaggaggaatcgctagtaatcgcaggtcagcatactgcggtgaatccgttcccgggccttgtacacaccgcccgtcacaccatggaagtgagccacgcccgaagtcattactctaacccgaaagggaggagggtgccgaaggcggggttgatgactggggtgaagtcgtaacaaggtagccgtaccggaaggtgtggctggatcacctcctttt

SEQ ID NO: 6759 - DNA, 1492 bp, Planktothrix sp. PCC 11201
  ref <308>: DATABASE ACCESSION NUMBER: NCBI ACCESSION: NZ_LT797686.1
  ref <309>: DATABASE ENTRY DATE: 2019-04-01
  ref <313>: RELEVANT RESIDUES IN SEQ ID NO: (1)..(1492)
aaaatggagagtttgatcctggctcaggatgaacgctggcggtctgcttaacacatgcaagtcgaacggaatccctcgggatttagtggcggacgggtgagtaacacgtaagaacctgcctctaggacggggacaacagttggaaacgactgctaaacccggatgagccgaaaggtaaaagatttatcgcctagagaggggcttgcgtctgattagctagttggtaaggtaaaggcttaccaaggcgacgatcagtagctggtctgagaggatgatcagccacactgggactgagacacggcccagactcctacgggaggcagcagtggggaattttccgcaatgggcgaaagcctgacggagcaagaccgcgtgggggaggaaggttcttggattgtcaaccccttttctcagggaagaactcaatgacggtacctgaggaaaaagcatcggctaactccgtgccagcagccgcggtaatacgggggatgcaagcgttatccggaatgattgggcgtaaagagtccgtaggtagtcaatcaagtctgctgttaaagagcgaggcttaacttcgtaaaggcagtggaaactgtaagactagagtgtagtaggggcagagggaattcctggtgtagcggtgaaatgcgtagagatcaggaagaacaccggtggcgaaggcgctctgctgggctataactgacactgagggacgaaagctaggggagcgaatgggattagataccccagtagtcctagcggtaaacgatggaaactaggtgtggcctgtatcgacccgggccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccaggacttgacatctctggaatcctgctgaaaggtgggagtgccgaaaggaaccagaagacaggtgctgcatggctgtcgtcagctcgtgtcgtgagatgttgggttaagtcccgcaacgagcgcaaccctcgtcgttagttgccatcattaagttgggaactctagcgagactgccggtgacaaaccggaggaaggtgaggatgacgtcaagtcagcatggcccttacgtcctgggcgacacacgtactacaatgcgagggacagagagcagccaacccgcgagggagagcgaacctcttaaaccctggcacagttcagattgcaggctgcaactcgcctgcatgaaggaggaatcgctagtaatcgcaggtcagcatactgcggtgaatccgttcccgggccttgtacacaccgcccgtcacaccatggaagtgagccacgcccgaagtcattactctaacccgtaaggggggagggtgccgaaggcggggttgatgactggggtgaagtcgtaacaaggtagccgtaccggaaggtgtggctggatcacctcctttt

SEQ ID NO: 6760 - DNA, 1498 bp, Planktothrix tepida
  ref <308>: DATABASE ACCESSION NUMBER: NCBI ACCESSION: NZ_LN889782.1
  ref <309>: DATABASE ENTRY DATE: 2019-04-01
  ref <313>: RELEVANT RESIDUES IN SEQ ID NO: (1)..(1498)
aaaatggagagtttgatcctggctcaggatgaacgctggcggtctgcttaacacatgcaagtcgaacgggaatcttaggattctagtggcggacgggtgagtaacacgtaagaacctgcctgttggacggggacaacagttggaaacgactgctaatcccggatgagccgagaggtaaaagatttatcgccaacagaggggcttgcgtctgattagctagttggtagtgtaagggactaccaaggcgacgatcagtagctggtctgagaggatgatcagccacactgggactgagacacggcccagactcctacgggaggcagcagtggggaattttccgcaatgggcgaaagcctgacggagcaagaccgcgtgggggaggaaggttcttggattgtcaaccccttttctcagggaagaagaaagtgacggtacctgaggaagaagcatcggctaactccgtgccagcagccgcggtaatacggaggatgcaagcgttatccggaatgattgggcgtaaagagtccgtaggtagcccctcaagtctgctgttaaagagcgaggcttaacttcgtaaaggcagtggaaactggggagctagagtgtagtaggggcagagggaattcctggtgtagcggtgaaatgcgtagagatcaggaagaacaccggtggcgaaagcgctctgctgggctacaactgacactgagggacgaaagctaggggagcgaatgggattagataccccagtagtcctagcggtaaacgatggaaactaggtgtggcctgtatcgacccgggccgtgccggagcaaacgcgttaagtttcccgcctggggagtacgcacgcaagtgtgaaactcaaaggaattgacgggggcccgcacaagcggtggagtatgtggtttaattcgatgcaacgcgaagaaccttaccaggacttgacatctctggaatctctctgaaaggagagagtgccttagggaaccagaagacaggtgctgcatggctgtcgtcagctcgtgtcgtgagatgttgggttaagtcccgcaacgagcgcaaccctcgtcgttagttgccatcattaagttgggaactctagcgagactgccggtgacaaaccggaggaaggtgaggatgacgtcaagtcagcatggcccttacgtcctgggcgacacacgtactacaatgctaaggacagagagcagccaacccgcgagggagagcgaatctcagaaaccttggcacagttcagattgcaggctgcaactcgcctgcatgaaggaggaatcgctagtaatcgcaggtcagcatactgcggtgaatccgttcccgggccttgtacacaccgcccgtcacaccatggaagttcgccacgcccgaagtcattactctaacccgcaaggggggagggtgccgaaggcagggctgatgactggggtgaagtcgtaacaaggtagccgtaccggaaggtgtggctggatcacctcctttttaggga

SEQ ID NO: 6761 - DNA, 1557 bp, Planococcus antarcticus
  ref <308>: DATABASE ACCESSION NUMBER: NCBI ACCESSION: NZ_CP016534.2
  ref <309>: DATABASE ENTRY DATE: 2019-04-01
  ref <313>: RELEVANT RESIDUES IN SEQ ID NO: (1)..(1557)
ctataatggagagtttgatcctggctcaggacgaacgctggcggcgtgcctaatacatgcaagtcgagcggaaccagaggagcttgctccttctggtttagcggcggacgggtgagtaacacgtgggcaacctgccctgcagatcgggataactccgggaaaccggtgctaataccgaatagtttgtcgcctctcctgaggcggcacggaaagacggcatctcgctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaactaactactggtaccttgacggtacctcaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccggtgtagagatacgcctttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagggctgcaaccccgcgagggcaagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacggatgattggggtgaagtcgtaacaaggtagccgtatcggaaggtgcggctggatcacctcctttcta

SEQ ID NO: 6762 - DNA, 1554 bp, Planococcus citreus
  ref <308>: DATABASE ACCESSION NUMBER: NCBI ACCESSION: NZ_RCCP01000013.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcgtgcctaatacatgcaagtcgagcggagatagtggagcttgctccattatcttagcggcggacgggtgagtaacacgtgggcaacctgccctgcagatcgggataactccgggaaaccggtgctaataccgaatagtttgcggcctctcatgaggctgcacggaaagacggtttcggctgtcactgcaggatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaactaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 6763 - DNA, 1556 bp, Planococcus donghaensis
  ref <308>: DATABASE ACCESSION NUMBER: NCBI ACCESSION: NZ_CP016543.2
  ref <309>: DATABASE ENTRY DATE: 2019-04-01
  ref <313>: RELEVANT RESIDUES IN SEQ ID NO: (1)..(1556)
ctataatggagagtttgatcctggctcaggacgaacgctggcggcgtgcctaatacatgcaagtcgagcggaaccagaggagcttgctccttctggtttagcggcggacgggtgagtaacacgtgggcaacctgccctgcagatcgggataactccgggaaaccggtgctaataccgaatagtttgcggcctctcctgaggctgcacggaaagacggtttcggctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaactaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgcccggtgtagagatacgcttttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccataaaaccgttctcagttcggattgtaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6764 - DNA, 1556 bp, Planococcus faecalis
  ref <308>: DATABASE ACCESSION NUMBER: NCBI ACCESSION: NZ_CP019401.1
  ref <309>: DATABASE ENTRY DATE: 2019-04-01
  ref <313>: RELEVANT RESIDUES IN SEQ ID NO: (1)..(1556)
ctataatggagagtttgatcctggctcaggacgaacgctggcggcgtgcctaatacatgcaagtcgagcggaactttgggagcttgctcccattgtttagcggcggacgggtgagtaacacgtgggcaacctgccctgcagatcgggataactccgggaaaccggtgctaataccgaatagtttgcggcctctcctgaggctgcacggaaagacggcatctcgctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggttctttaagtccgatgtgaaagcccacggctcaaccgtggagggtcattggaaactggggaacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtgtagagatacgcttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaccccgcgagggcaagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6765 - DNA, 1556 bp, Planococcus halocryophilus
  ref <308>: DATABASE ACCESSION NUMBER: NCBI ACCESSION: NZ_CP016537.2
  ref <309>: DATABASE ENTRY DATE: 2019-04-01
  ref <313>: RELEVANT RESIDUES IN SEQ ID NO: (1)..(1556)
ctataatggagagtttgatcctggctcaggacgaacgctggcggcgtgcctaatacatgcaagtcgagcggaaccagaggagcttgctccttctggtttagcggcggacgggtgagtaacacgtgggcaacctgccctgcagatcgggataactccgggaaaccggtgctaataccgaatagtttgcggcctctcctgaggctgcacggaaagacggtttcggctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaactaactactggtaccttgacggtacctcaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtgtagagatacacttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccataaaaccgttctcagttcggattgtaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacggatgattggggtgaagtcgtaacaaggtagccgtatcggaaggtgcggctggatcacctcctttcta

SEQ ID NO: 6766 - DNA, 1554 bp, Planococcus halotolerans
  ref <308>: DATABASE ACCESSION NUMBER: NCBI ACCESSION: NZ_QLZR01000001.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcgtgcctaatacatgcaagtcgagcggagaatttggagcttgctccaaattcttagcggcggacgggtgagtaacacgtgggcaacctgccctgcagatcgggataactccgggaaaccggtgctaataccgaatagtttggggcctctcctgaggccccacggaaagacggtttcggctgtcactgcaggatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaaccacttgtggagccagccgccgaaggtgggacagatgattggggtgaagtcgtaacaaggtagccgtatcggaaggtgcggctggatcacctcctttcta

SEQ ID NO: 6767 - DNA, 1556 bp, Planococcus kocurii
  ref <308>: DATABASE ACCESSION NUMBER: NCBI ACCESSION: NZ_CP013661.2
  ref <309>: DATABASE ENTRY DATE: 2019-04-01
  ref <313>: RELEVANT RESIDUES IN SEQ ID NO: (1)..(1556)
ctataatggagagtttgatcctggctcaggacgaacgctggcggcgtgcctaatacatgcaagtcgagcggaaccagaggagcttgctccttctggtttagcggcggacgggtgagtaacacgtgggcaacctgccctgcagatcgggataactccgggaaaccggtgctaataccgaatagtttgcggcctctcctgaggctgcacggaaagacggtctcggctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggttccttaagtccgatgtgaaagcccacggctcaaccgtggagggtcattggaaactggggaacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtgtagagatacgcttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaccccgcgagggcaagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6768 - DNA, 1554 bp, Planococcus maitriensis
  ref <308>: DATABASE ACCESSION NUMBER: NCBI ACCESSION: NZ_QLZQ01000015.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcgtgcctaatacatgcaagtcgagcggagatcttggagcttgctccaggatcttagcggcggacgggtgagtaacacgtgggcaacctgccctgcagatcgggataactccgggaaaccggtgctaataccgaatagtttgcggcctctcatgaggccacacggaaagacggtttcggctgtcactgcaggatgggcccgcggcgcattagctagttggtggggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaactaactattggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagacaaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggtcgcgaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 6769 - DNA, 1479 bp, Planococcus maritimus
  ref <308>: DATABASE ACCESSION NUMBER: NCBI ACCESSION: NZ_MINM01000003.1
  ref <309>: DATABASE ENTRY DATE: 2019-04-01
  ref <313>: RELEVANT RESIDUES IN SEQ ID NO: (1)..(1479)
ggagcttgctcctttggtttagcggcggacgggtgagtaacacgtgggcaacctgccctgcagatcgggataactccgggaaaccggtgctaataccgaatagtttgcggcctctcatgaggctgtacggaaagacggtttcggctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaattaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 6770 - DNA, 1554 bp, Planococcus massiliensis
  ref <308>: DATABASE ACCESSION NUMBER: NCBI ACCESSION: NZ_CCXS01000001.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcgtgcctaatacatgcaagtcgagcggaactgggggagcttgctccttccggtttagcggcggacgggtgagtaacacgtgggcaacctgccctgcagatcgggataactccgggaaaccggtgctaataccgaatagtttggcgcctctcctgaggcgccacggaaagacggtttcggctgtcactgcaggatgggcccgcggcgcattagctagttggtggggtaacggcccaccaaggcgacgatgcgtagccgacctgagagggtgaccggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaacacgtaccaactaactattggtaccttgacggtacctcaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccggtgtagagatacgcctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaacccttatgggagccagccgccgaaggtgggacagatgattggggtgaagtcgtaacaaggtagccgtatcggaaggtgcggctggatcacctcctttct

SEQ ID NO: 6771 - DNA, 1557 bp, Planococcus plakortidis
  ref <308>: DATABASE ACCESSION NUMBER: NCBI ACCESSION: NZ_CP016539.2
  ref <309>: DATABASE ENTRY DATE: 2019-04-01
  ref <313>: RELEVANT RESIDUES IN SEQ ID NO: (1)..(1557)
ctataatggagagtttgatcctggctcaggacgaacgctggcggcgtgcctaatacatgcaagtcgagcggaaccattggagcttgctcctttggtttagcggcggacgggtgagtaacacgtgggcaacctgccctgcagatcgggataactccgggaaaccggtgctaataccgaatagtttgcggcctctcatgaggctgtacggaaagacggtttcggctgtcactgcaggatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagacaaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggtcgcgaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttatgggagccagccgccgaaggtgggacagatgattggggtgaagtcgtaacaaggtagccgtatcggaaggtgcggctggatcacctcctttctaa

SEQ ID NO: 6772 - DNA, 1557 bp, Planococcus rifietoensis
  ref <308>: DATABASE ACCESSION NUMBER: NCBI ACCESSION: NZ_CP013659.2
  ref <309>: DATABASE ENTRY DATE: 2019-04-01
  ref <313>: RELEVANT RESIDUES IN SEQ ID NO: (1)..(1557)
ctataatggagagtttgatcctggctcaggacgaacgctggcggcgtgcctaatacatgcaagtcgagcggagataatggagcttgctccattatcttagcggcggacgggtgagtaacacgtgggcaacctgccctgcagatcgggataactccgggaaaccggtgctaataccgaatagtttgcggcctctcatgaggctgcacggaaagacggtttcggctgtcactgcaggatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 6773 - DNA, 892 bp, Planococcus salinus
  ref <308>: DATABASE ACCESSION NUMBER: NCBI ACCESSION: NZ_RIAX01000031.1
  ref <309>: DATABASE ENTRY DATE: 2019-04-01
  ref <313>: RELEVANT RESIDUES IN SEQ ID NO: (1)..(892)
tattgggcgtaaagcgcgcgcaggcggtcttttaagtctgatgtgaaagcccacggctcaaccgtggagggtcattggaaactggaggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccctggagacagggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggtcgcgaacccgcgaggggaagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaacccg

SEQ ID NO: 6774 - DNA, 1556 bp, Planococcus sp. CAU13
  ref <308>: DATABASE ACCESSION NUMBER: NCBI ACCESSION: NZ_JRGN01000090.1
  ref <309>: DATABASE ENTRY DATE: 2019-04-01
  ref <313>: RELEVANT RESIDUES IN SEQ ID NO: (1)..(1556)
ctataatggagagtttgatcctggctcaggacgaacgctggcggcgtgcctaatacatgcaagtcgagcggagaaattggagcttgctccagtttcttagcggcggacgggtgagtaacacgtgggcaacctgccctgcagatcgggataactccgggaaaccggtgctaataccgaatagtttgtttcacctcctggtgaaacacggaaagacggtttcggctgtcactgcaggatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaaaccgtaccaagtaactactggtaccttgacggtacctcaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccctggagacagggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttctaa

SEQ ID NO: 6775 - DNA, 1547 bp, Planococcus sp. MB-3u-03
  ref <308>: DATABASE ACCESSION NUMBER: NCBI ACCESSION: NZ_CP025135.1
  ref <309>: DATABASE ENTRY DATE: 2019-04-01
  ref <313>: RELEVANT RESIDUES IN SEQ ID NO: (1)..(1547)
ataatggagagtttgatcctggctcaggacgaacgctggcggcgtgcctaatacatgcaagtcgagcggaaccattggagcttgctcctttggtttagcggcggacgggtgagtaacacgtgggcaacctgccctgcagatcgggataactccgggaaaccggtgctaataccgaatagtttgcggcctctcatgaggctgcacggaaagaacggtttcggctgtcactgcaggatgggcccgcggcgcattagctagttggtgaggtaacggctcaccaaggccacgatgcgtagccgacctgagagggtgatcggccacactgggactgagacacggcccagactcctacggaggcagcagtagggaatcttccgcaatggacgaaagtctgacggagcaacgccgcgtgagtgaagaaggttttcggatcgtaaaactctgttgtgagggaagaacaagtaccaagtaactactggcaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttggggtttccgccccttagtgctgcagctaacgcattaagcactccgcctggggagtacggccgcaaggctgaaactcaaaggaattgacggggcccgcacaagcggtggagcatgtggtttaattcgaagcaacgcgaagaaccttaccaggtcttgacatcccgctgaccgcctaggagattaggctttccttcggggacagcggtgacaggtggtgcatggttgtcgtcagctcgtgtcgtgagatgttgggttaagtcccgcaacgagcgcaacccttgatcttagttgccagcattcagttgggcactctaaaggtgactgccggtgacaaaccggaggaaggtggggatgacgtcaaatcatcatgccccttatgacctgggctacacacgtgctacaatggacggtacaagggctgcaaacccgcgaggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttct

SEQ ID NO: 6776 - DNA, 1554 bp, Planococcus sp. MB-3u-09
  ref <308>: DATABASE ACCESSION NUMBER: NCBI ACCESSION: NZ_PJBN01000040.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcgtgcctaatacatgcaagtcgagcggaaccattggagcttgctcctttggtttagcggcggacgggtgagtaacacgtgggcaacctgccctgcagatcgggataactccgggaaaccggtgctaataccgaatagtttgcggcctctcatgaggctgcacggaaagacggtttcggctgtcactgcaggatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctaggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggctgcaaacccgcgagggggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 6777 - DNA, 1555 bp, Planococcus sp. PAMC 21323
  ref <308>: DATABASE ACCESSION NUMBER: NCBI ACCESSION: NZ_CP009129.1
  ref <309>: DATABASE ENTRY DATE: 2019-04-01
  ref <313>: RELEVANT RESIDUES IN SEQ ID NO: (1)..(1555)
ctataatggagagtttgatcctggctcaggacgaacgctggcggcgtgcctaatacatgcaagtcgagcggaactttgggagcttgctcccattgtttagcggcggacgggtgagtaacacgtgggcaacctgccctgcagatcgggataactccgggaaaccggtgctaataccgaatagtttgcggcctctcctgaggctgcacggaaagacggtttcggctgtcactgcaggatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgcccggtgtagagatacacttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccataaaaccgttctcagttcggattgtaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6778 - DNA, 1554 bp, Planococcus sp. Urea-3u-39; identical to SEQ ID NO: 6776
  ref <308>: DATABASE ACCESSION NUMBER: NCBI ACCESSION: NZ_PJCB01000012.1
  ref <309>: DATABASE ENTRY DATE: 2019-04-01
  ref <313>: RELEVANT RESIDUES IN SEQ ID NO: (1)..(1554)

SEQ ID NO: 6779 - DNA, 1554 bp, Planococcus sp. Urea-trap-24; identical to SEQ ID NO: 6776
  ref <308>: DATABASE ACCESSION NUMBER: NCBI ACCESSION: NZ_PJCC01000009.1
  ref <309>: DATABASE ENTRY DATE: 2019-04-01
  ref <313>: RELEVANT RESIDUES IN SEQ ID NO: (1)..(1554)

SEQ ID NO: 6780 - DNA, 1557 bp, Planococcus sp. Y42
  ref <308>: DATABASE ACCESSION NUMBER: NCBI ACCESSION: NZ_CP019640.1
  ref <309>: DATABASE ENTRY DATE: 2019-04-01
  ref <313>: RELEVANT RESIDUES IN SEQ ID NO: (1)..(1557)
tatcggagagtttgatcctggctcaggacgaacgctggcggcgtgcctaatacatgcaagtcgagcggacgaatcgggagcttgctcccggttcgttagcggcggacgggtgagtaacacgtgggcaacctgccctgcagatcgggataactccgggaaaccggtgctaataccggataggtcggaacctcgcatgaggttccgcggaaagacggcatctcgctgtcactgcaggatgggcccgcggcgcattagctagttggtggggtagtggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacacgtaccagttaactgctggtaccttgacggtaccttaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccctggagacagggcttccccttcgggggcagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaccccgcgagggcaagcgaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 6781 - DNA, 1555 bp, Planococcus versutus
  ref <308>: DATABASE ACCESSION NUMBER: NCBI ACCESSION: NZ_CP016540.2
  ref <309>: DATABASE ENTRY DATE: 2019-04-01
  ref <313>: RELEVANT RESIDUES IN SEQ ID NO: (1)..(1555)
ctataatggagagtttgatcctggctcaggacgaacgctggcggcgtgcctaatacatgcaagtcgagcggaaccattggagcttgctcctttggtttagcggcggacgggtgagtaacacgtgggcaacctgccctgcagatcgggataactccgggaaaccggtgctaataccgaatagtttgcggcctctcctgaggctgcacggaaagacggtctcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaaactctgttgtgagggaagaacaagtgccaagtaactactggcaccttgacggtacctcaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtacagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgcccggtgtagagatacacttttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagggttgccaacccgcgagggggagctaatcccagaaaaccgttctcagttcggattgtaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacggatgattggggtgaagtcgtaacaaggtagccgtatcggaaggtgcggctggatcacctcctttcta

SEQ ID NO: 6782 - DNA, 1469 bp, Planomicrobium flavidum
  ref <308>: DATABASE ACCESSION NUMBER: NCBI ACCESSION: NZ_NHTN01000057.1
  ref <309>: DATABASE ENTRY DATE: 2019-04-01
  ref <313>: RELEVANT RESIDUES IN SEQ ID NO: (1)..(1469)
tcgaacttcagcggcggacgggtgagtaacacgtgggcaacctgccctgcagatcgggataactccgggaaaccggcgctaataccggatagctcagaaccccgcatggggttctgcggaaaggcggtcttcgggctgccgctgcaggatgggcccgcggcgcattagctggttggtggggtagtggcccaccaaggcgacgatgcgtagccgacctgagagggtgaccggccacactgggactgagacacggcccagactcctacgggaggcagcagtagggaatcttccgcaatggacgcaagtctgacggagcaacgccgcgtgagtgaagaaggttttcggatcgtaaagctctgttgtgagggaagaacacgcaccagttaactgctggtgccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaatcccgcggctcaaccgcgggcggccattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgcctgggagaccaggcttccccttcgggggcagcggtgacaggtggtgcatggttgtcgtcagctcgtgtcgtgagatgttgggttaagtcccgcaacgagcgcaacccttgatcttagttgccagcattcggttgggcactctaaggtgactgccggtgacaaaccggaggaaggtggggatgacgtcaaatcatcatgccccttatgacctgggctacacacgtgctacaatggacggcacaaagggcagcgaccccgcgagggcaagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtggggtaacctttttggagccagccgccgaaggtgggacagatgattggggtgaagtcgtaacaaggtagccgtatcggaaggtgcggctggatcacctcctttctaa

SEQ ID NO: 6783 - DNA, 545 bp, Planomicrobium glaciei
  ref <308>: DATABASE ACCESSION NUMBER: NCBI ACCESSION: NZ_FNDC01000025.1
  ref <309>: DATABASE ENTRY DATE: 2019-04-01
  ref <313>: RELEVANT RESIDUES IN SEQ ID NO: (1)..(545)
ctataatggagagtttgatcctggctcaggacgaacgctggcggcgtgcctaatacatgcaagtcgagcggaagttgaagagcttgctcttcaactttagcggcggacgggtgagtaacacgtgggcaacctgccctgcagatcgggataactccgggaaaccggtgctaataccgaatagttttgggtccctcctgggacccaacggaaagacggtttcggctgtcactgcaggatgggcccgcggcgcattagctagttggtggggtaacggcccaccaaggccacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaaactctgttgcgagggaagaaaccgtgccagctaactactggcaccttgacggtacctcgccagaaagccacggctaactacgtgccagcagccgcggtaatacgt

SEQ ID NO: 6784 - DNA, 1362 bp, Planomicrobium okeanokoites
  ref <308>: DATABASE ACCESSION NUMBER: NCBI ACCESSION: NZ_FWYH01000004.1
  ref <309>: DATABASE ENTRY DATE: 2019-04-01
  ref <313>: RELEVANT RESIDUES IN SEQ ID NO: (1)..(1362)
ttagcggcggacgggtgagtaacacgtgggcaacctgccctgcagatcgggataactccgggaaaccggtgctaataccgaatagttttttgcccctcctggggcgaaacggaaagacggtttcggctgtcactgcaggatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttagagataaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacc

SEQ ID NO: 6785 - DNA, 1554 bp, Planomicrobium soli
  ref <308>: DATABASE ACCESSION NUMBER: NCBI ACCESSION: NZ_PYAT01000028.1
  ref <309>: DATABASE ENTRY DATE: 2019-04-01
  ref <313>: RELEVANT RESIDUES IN SEQ ID NO: (1)..(1554)
ataatggagagtttgatcctggctcaggacgaacgctggcggcatgcctaatacatgcaagtcgagcggaaccggaagagcttgctctttccggtttagcggcggacgggtgagtaacacgtgggcaacctgccctgcagatcgggataactccgggaaaccggtgctaataccgaatagtttggaacctctcctgaggttccacggaaagacggtttcgactgtcactgcaggatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgcaagtctgacggagcaatgccgcgtgagtgacgaaggttttcggatcgtaaaactctgttgtgagggaagaaaccgtaccaagtaactactggtaccttgacggtacctcaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagacaaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6786 - DNA, 1553 bp, Planomicrobium sp. MB-3u-38
  ref <308>: DATABASE ACCESSION NUMBER: NCBI ACCESSION: NZ_PJBO01000058.1
  ref <309>: DATABASE ENTRY DATE: 2019-04-01
  ref <313>: RELEVANT RESIDUES IN SEQ ID NO: (1)..(1553)
ataatggagagtttgatcctggctcaggacgaacgctggcggcgtgcctaatacatgcaagtcgagcggaacctttggagcttgctccattggtttagcggcggacgggtgagtaacacgtgggcaacctgccctgcagatcgggataactccgggaaaccggtgctaataccgaatagttttttgcccctcctggggcgaaacggaaagacggtttcggctgtcactgcaggatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaacaagtaccaagtaactactggtaccttgacggtacctcaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttagagataaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaaggtagccgtatcggaaggtgcggctggatcacctcctttcta

SEQ ID NO: 6787 - DNA, 1352 bp, Planomicrobium sp. Y74
  ref <308>: DATABASE ACCESSION NUMBER: NCBI ACCESSION: NZ_RCWH01000016.1
  ref <309>: DATABASE ENTRY DATE: 2019-04-01
  ref <313>: RELEVANT RESIDUES IN SEQ ID NO: (1)..(1352)
acggaaagacggtttcggctgtcactgcaggatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaaggttttcggatcgtaaaactctgttgtgagggaagaacaagtaccaactaactactggtaccttgacggtacctcaccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagactaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaaccacttgtggagccagccgccgaaggtgggacagatgattggggtgaagtcgtaacaaggtagccgtatcggaaggtgcggctggatcacctcctttcta

SEQ ID NO: 6788 - DNA, 1524 bp, Plantibacter sp. PA-3-X8
  ref <308>: DATABASE ACCESSION NUMBER: NCBI ACCESSION: NZ_CP033107.1
  ref <309>: DATABASE ENTRY DATE: 2019-04-01
  ref <313>: RELEVANT RESIDUES IN SEQ ID NO: (1)..(1524)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggatggagctgtctaaggtgggatcggtaattaggactaagtcgtaacaaggtagccgtaccggaaggtgcggctggatcacctcctttcta

SEQ ID NO: 6789 - DNA, 1524 bp, Plantibacter sp. VKM Ac-1784
  ref <308>: DATABASE ACCESSION NUMBER: NCBI ACCESSION: NZ_FXWJ01000008.1
  ref <309>: DATABASE ENTRY DATE: 2019-04-01
  ref <313>: RELEVANT RESIDUES IN SEQ ID NO: (1)..(1524)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaacggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggatggagctgtctaaggtgggatcggtaattaggactaagtcgtaacaaggtagccgtaccggaaggtgcggctggatcacctcctttcta

SEQ ID NO: 6790 - DNA, 1524 bp, Plantibacter sp. YR521
  ref <308>: DATABASE ACCESSION NUMBER: NCBI ACCESSION: NZ_RBIC01000005.1
  ref <309>: DATABASE ENTRY DATE: 2019-04-01
  ref <313>: RELEVANT RESIDUES IN SEQ ID NO: (1)..(1524)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaacggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtcatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggatggagctgtctaaggtgggatcggtaattaggactaagtcgtaacaaggtagccgtaccggaaggtgcggctggatcacctcctttcta

SEQ ID NO: 6791 - DNA, 1538 bp, Plasticicumulans acidivorans
  ref <308>: DATABASE ACCESSION NUMBER: NCBI ACCESSION: NZ_QGTJ01000023.1
  ref <309>: DATABASE ENTRY DATE: 2019-04-01
  ref <313>: RELEVANT RESIDUES IN SEQ ID NO: (1)..(1538)
gaactgaagagtttgatcctggctcagattgaacgctggcggcatgcttaacacatgcaagtcgaacgggatcctggtttcggccgggtgagagtggcggacgggtgagtaatacgtaggaatctgcccacgggtgggggacaacatggggaaactcatgctaataccgcataagccctaagggggaaagcgggggaccttcgggcctcgcgccggtggatgagcctacgtcggattagctagttggtagggtaagagcctaccaaggcgacgatccgtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttaagcagggaggaggggtactggcgtgaatagcgttggtatctgacgttacctgcagaataagcaccggctaacttcgtgccagcagccgcggtaatacgaagggtgcaagcgttaatcggaattactgggcgtaaagcgcgtgtaggcggttatttaagtcagatgtgaaagccccgggctcaacctgggaatggcatttgatactgggtaactggaatgtggtagagggaggcggaatttccggtgtagcggtgaaatgcgtagatatcggaaagaacaccaatggcgaaggcagcctcctgggccaacattgacgctgagacgcgaaagcgtggggagcaaacaggattagataccctggtagtccacgccctaaacgatgagaactggacggtggggaggtcactcttcgctgttgaagctaacgcgttaagttctccgcctggggagtacggccgcaaggttgaaactcaaaggaattgacgggggcccgcacaagcggtggagcatgtggtttaattcgatgcaacgcgaagaaccttacctggccttgacatctgtcgaattctgcagagatgcggaagtgccttcgggagcgacaagacaggtgctgcatggctgtcgtcagctcgtgtcgtgagatgttgggttaagtcccgcaacgagcgcaacccttgtccttagttgccagcacttcgggtgggaactctaaggagactgccggtgataaaccggaggaaggtggggatgacgtcaagtcatcatggcccttatggccagggctacacacgtgctacaatggtcggtacaaagggttgccaagtcgcgaggcggagctaatcccataaagccggtcgtagtccggattggagtctgcaactcgactccatgaagtcggaatcgctagtaatcgcagatcagcactgctgcggtgaatacgttcccgggccttgtacacaccgcccgtcacaccatgggagttggttgcaccagaagcaggtagcttaaccttcgggagggcgcttgccacggtgtggtcaatgactggggtgaagtcgtaacaaggtagccgtaggggaacctgcggctggatcacctcctttaaa

SEQ ID NO: 6792 - DNA, 1489 bp, Pleomorphomonas carboxyditropha
  ref <308>: DATABASE ACCESSION NUMBER: NCBI ACCESSION: NZ_NQVN01000056.1
  ref <309>: DATABASE ENTRY DATE: 2019-04-01
  ref <313>: RELEVANT RESIDUES IN SEQ ID NO: (1)..(1489)
gaacatgagagtttgatcctggctcagaacgaacgctggcggcaggcttaacacatgcaagtcgaacgctcgcagcaatgcgggagtggcagacgggtgagtaacgcgtgggaacataccctttggttcggaataactgagagaaatttcagctaataccggatgtgcccttcgggggaaagatttatcgccaaaggattggcccgcgtctgattagctagttggtggggtaacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgtcagggaagataatgacggtacctgaagaagaagccccggctaacttcgtgccagcagccgcggtaatacgaagggggctagcgttgttcggaattactgggcgtaaagcgcacgtaggcggacatttaagtcaggggtgaaatcccagggctcaaccctggaactgcctttgatactgggtgtcttgagtacgagagaggtgagtggaattccgagtgtagaggtgaaattcgtagatattcggaagaacaccagtggcgaaggcggctcactggctcgtaactgacgctgaggtgcgaaagcgtggggagcaaacaggattagataccctggtagtccacgctgtaaacgatgaatgccagccgttgggcgacttgtcgttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcccttgacatccgtcgaccggtggagagatccattttgcccttcggggccggcgagacaggtgctgcatggctgtcgtcagctcgtgtcgtgagatgttgggttaagtcccgcaacgagcgcaaccctcgccttcagttgccagcatttagttgggcactctggagggactgccggtgataagccggaggaaggtggggatgacgtcaagtcctcatggcccttacgggctgggctacacacgtgctacaatggcggtgacaatgggcagcgacttcgcgaggaggagctaatcccaaaaagccgtctcagttcggattgcactctgcaactcgagtgcatgaagtcggaatcgctagtaatcgcgtaacagcatgacgcggtgaatacgttcccgggccttgtacacaccgcccgtcacaccatgggagttggctttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 6793 - DNA, 1411 bp, Pleomorphomonas diazotrophica
  ref <308>: DATABASE ACCESSION NUMBER: NCBI ACCESSION: NZ_PJNW01000020.1
  ref <309>: DATABASE ENTRY DATE: 2019-04-01
  ref <313>: RELEVANT RESIDUES IN SEQ ID NO: (1)..(1411)
tacgggagtggcagacgggtgagtaacgcgtgggaacataccctttggttcggaataactgagagaaatttcagctaataccggatgtgccctatgggggaaagatttatcgccaaaggattggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgtcagggaagataatgacggtacctgaagaagaagccccggctaacttcgtgccagcagccgcggtaatacgaagggggctagcgttgttcggaattactgggcgtaaagcgcacgtaggcggacatttaagtcaggggtgaaatcccagggctcaaccctggaactgcctttgatactgggtgtcttgagtacgagagaggtgagtggaattccgagtgtagaggtgaaattcgtagatattcggaagaacaccagtggcgaaggcggctcactggctcgtaactgacgctgaggtgcgaaagcgtggggagcaaacaggattagataccctggtagtccacgctgtaaacgatgaatgccagccgttgggcgacgtgtcgttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcccttgacatccgtcgaccggtggagagatccattttgcccttcggggccggcgagacaggtgctgcatggctgtcgtcagctcgtgtcgtgagatgttgggttaagtcccgcaacgagcgcaaccctcgccttcagttgccagcatttggttgggcactctggagggactgccggtgataagccggaggaaggtggggatgacgtcaagtcctcatggcccttacgggctgggctacacacgtgctacaatggcggtgacaatgagcagcgacttcgcgaggagaagctaatctcaaaaagccgtctcagttcggattgcactctgcaactcgagtgcatgaagtcggaatcgctagtaatcgcgtaacagcatgacgcggtgaatacgttcccgggccttgtacacaccgcccgtcacaccatgggagttggctttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 6794 - DNA, 1392 bp, Pleomorphomonas koreensis
  ref <308>: DATABASE ACCESSION NUMBER: NCBI ACCESSION: NZ_AULH01000059.1
  ref <309>: DATABASE ENTRY DATE: 2019-04-01
  ref <313>: RELEVANT RESIDUES IN SEQ ID NO: (1)..(1392)
gagtaacacgtgggaacataccctttggttcggaataactgagagaaatttcagctaataccggatgagcccttcgggggaaagatttatcgccaaaggattggcccgcgtctgattaggtagttggtgaggtaacggctcaccaagccgacgatcagtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgctagggaagataatgacggtacctagagaagaagccccggctaacttcgtgccagcagccgcggtaatacgaagggggctagcgttgttcggaattactgggcgtaaagcgcacgtaggcggacatttaagtcaggggtgaaatcccggggctcaaccctggaactgcctttgatactgggtgtcttgagtacgagagaggtgagtggaattccgagtgtagaggtgaaattcgtagatattcggaagaacaccagtggcgaaggcggctcactggctcgtaactgacgctgaggtgcgaaagcgtggggagcaaacaggattagataccctggtagtccacgccgtaaacgatgaatgccagccgttgggtgacttgtcattcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcccttgacatccgtcgaccggtggagagatccattttgcccttcggggccggcgagacaggtgctgcatggctgtcgtcagctcgtgtcgtgagatgttgggttaagtcccgcaacgagcgcaaccctcgccttcagttgccagcattcagttgggcactctggagggactgccggtgataagccggaggaaggtggggatgacgtcaagtcctcatggcccttacgggctgggctacacacgtgctacaatggcggtgacaatgggcagcgacttcgcgaggaggagctaatcccaaaaagccgtctcagttcggattgcactctgcaactcgagtgcatgaagtcggaatcgctagtaatcgcgtaacagcatgacgcggtgaatacgttcccgggccttgtacacaccgcccgtcacaccatgggagttggctttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 6795 - DNA, 1492 bp, Pleomorphomonas oryzae
  ref <308>: DATABASE ACCESSION NUMBER: NCBI ACCESSION: NZ_AUHB01000035.1
  ref <309>: DATABASE ENTRY DATE: 2019-04-01
  ref <313>: RELEVANT RESIDUES IN SEQ ID NO: (1)..(1492)
ttgaacatgagagtttgatcctggctcagaacgaacgctggcggcaggcttaacacatgcaagtcgaacgctcgtagcaatacgggagtggcagacgggtgagtaacgcgtgggaacataccctttggttcggaataactgagagaaatttcagctaataccggatgtgcccttcgggggaaagatttatcgccaaaggattggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgtcagggaagataatgacggtacctgaagaagaagccccggctaacttcgtgccagcagccgcggtaatacgaagggggctagcgttgttcggaattactgggcgtaaagcgcacgtaggcggacatttaagtcaggggtgaaatcccagggctcaaccctggaactgcctttgatactgggtgtcttgagtacgagagaggtgagtggaattccgagtgtagaggtgaaattcgtagatattcggaagaacaccagtggcgaaggcggctcactggctcgtaactgacgctgaggtgcgaaagcgtggggagcaaacaggattagataccctggtagtccacgctgtaaacgatgaatgccagccgttgggtgacttgtcattcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcccttgacatccgtcgaccgtcgcagagatgcgtttttcccttcggggacggcgagacaggtgctgcatggctgtcgtcagctcgtgtcgtgagatgttgggttaagtcccgcaacgagcgcaaccctcgccttcagttgccagcatttagttgggcactctggagggactgccggtgataagccggaggaaggtggggatgacgtcaagtcctcatggcccttacgggctgggctacacacgtgctacaatggcggtgacaatgagcagcgacttcgcgaggagaagctaatctcaaaaagccgtctcagttcggattgcactctgcaactcgagtgcatgaagtcggaatcgctagtaatcgcgtaacagcatgacgcggtgaatacgttcccgggccttgtacacaccgcccgtcacaccatgggagttggctttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 6796 - DNA, 1490 bp, Pleomorphomonas sp. SM30
  ref <308>: DATABASE ACCESSION NUMBER: NCBI ACCESSION: NZ_AP017626.1
  ref <309>: DATABASE ENTRY DATE: 2019-04-01
  ref <313>: RELEVANT RESIDUES IN SEQ ID NO: (1)..(1490)
gaacctgagagtttgatcctggctcagaacgaacgctggcggcaggcttaacacatgcaagtcgaacgctcgtggcaacacgggagtggcagacgggtgagtaacgcgtgggaacctacctcatggtgcggaataactcagggaaacttgagctaataccgcatgtgcccttcggggggaaagatttatcgccatgggatgggcccgcgtcggattagctagttggtggggtaacggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgttcggaattactgggcgtaaagcgcacgtaggcggatatttaagtcgggggtgaaatcccagggctcaaccctggaactgcctccgatactgggtatctcgagtccgagagaggtgagtggaattccgagtgtagaggtgaaattcgtagatattcggaagaacaccagtggcgaaggcggctcactggctcggaactgacgctgaggtgcgaaagcgtggggagcaaacaggattagataccctggtagtccacgccgtaaacgatggatgccagccgttgggcagcttgctgttcagtggcgccgctaacgcattaagcatcccgcctggggagtacggtcgcaagattaaaactcaaaggaattgacgggggcccgcacaagcggtggagcatgtggtttaattcgaagcaacgcgcagaaccttaccagcctttgacatcctgtgcgacccagagagatttggggttcccttcggggacgcagagacaggtgctgcatggctgtcgtcagctcgtgtcgtgagatgttgggttaagtcccgcaacgagcgcaaccctcgcccccagttgccagcattcagttgggcactccggggggactgccggtgataagccgcgaggaaggtggggatgacgtcaagtcctcatggcccttacgggctgggctacacacgtgctacaatggcggtgacaatgggcagcgacctcgcgagggggagctaatcccaaaaagccgtctcagttcggattgcactctgcaactcgagtgcatgaagtcggaatcgctagtaatcgcgtaacagcatgacgcggtgaatacgttcccgggccttgtacacaccgcccgtcacaccatgggagttgggtttacccgaagacggtgcgccaaccgcaaggaggcagccggccacggtaggctcagcgactggggtgaagtcgtaacaaggtagccgtaggggaacctgcggctggatcacctcctttctaa

SEQ ID NO: 6797 - DNA, 1497 bp, Pleurocapsa minor
  ref <308>: DATABASE ACCESSION NUMBER: NCBI ACCESSION: NC_019689.1
  ref <309>: DATABASE ENTRY DATE: 2019-04-01
  ref <313>: RELEVANT RESIDUES IN SEQ ID NO: (1)..(1497)
aacatggagagtttgatcctggctcaggatgaacgctggcggcgtgcctaacacatgcaagtcgaacggggtggaaacacctagtggcggacgggtgagtaacgcgtgagaatctgccttcaggacggggacaacagcgggaaactgctgctaatacccgatgtgccgcaaggtgaaagaaattcgcctgaagaagagctcgcgtcagattagctagttggtagggtaaaagcctaccaaggcgacgatctgtagctggtctgagaggatgagcagccacactgggactgagacacggcccagactcctacgggaggcagcagtggggaattttccgcaatgggcgaaagcctgacggagcaacgccgcgtgagggaggaaggcctttgggttgtaaacctcttttgctcgggaagaagaaagtgacggtaccgagcgaatcagcctcggctaactccgtgccagcagccgcggtaagacggaggaggcaagcgttatccggaatcattgggcgtaaagagtccgtaggtggcaacgcaagtcggcggtcaaagaccggagcttaactccggagcggccgtggaaactgcgcagctagagtccggtaggggtagcgggaattcccagtgtagcggtgaaatgcgtagagattgggaagaacatcggtggcgaaagcgcgctactgggccggaactgacactgagggacgaaagctaggggagcgaaagggattagatacccctgtagtcctagctgtaaacgatggaaactaggcgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaaccctgccgaaaggcgggggtgccttcgggagccggaacacaggtgctgcatggctgtcgtcagctcgtgtcgtgagatgttgggttaagtcccgcaacgagcgcaaccctcgttcttagttgccagcaggtgaagctgggcactctagggagactgccggtgacaaaccggaggaaggtgaggatgacgtcaagtcagcatggcccttacgtcctgggcgacacacgtactacaatggtagggacaaagggcagcgaccccgcgagggcgagcgaatctcagcaaaccctacctcagttcagattgcaggctgcaactcgcctgcatgaaggaggaatcgctagtaatcgccggtcagcatacggcggtgaatccgttcccgggccttgtacacaccgcccgtcacaccatgggagctggccacgcccgaagtcgttactccaaccgatgaggaggaggatgccgaaggcagggctagtgactggggtgaagtcgtaacaaggtagccgtaccggaaggtgtggctggatcacctcctttttaggga

SEQ ID NO: 6798 - DNA, 1494 bp, Pleurocapsa sp. PCC 7319
  ref <308>: DATABASE ACCESSION NUMBER: NCBI ACCESSION: NZ_KB235922.1
  ref <309>: DATABASE ENTRY DATE: 2019-04-01
  ref <313>: RELEVANT RESIDUES IN SEQ ID NO: (1)..(1494)
atcatggagagtttgatcctggctcaggatgaacgctggcggtatgcctaacacatgcaagtcgaacgaaatcttcggatttagtggcggacgggtgagtaacgcgtgagaatctgccttcaggatggggacaacagggagaaatcgctgctaatacccaatatgccctcgggtgaaatatttatagcctggagaagagctcgcgtccgattagttagttggtggggtaaaagcctaccaaggcggcgatcggtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttttcaaggaagaagaaagtgacggtacttgaagaataagcatcggctaactccgtgccagcagccgcggtaatacggaggatgcaagcgttatccggaatcattgggcgtaaagcgtccgcaggtggctgtacaagtctgctgttaaagacagaagctcaacttctggcaagcggtggaaactgttcagctagagtacggtaggggttgagggaattcccagtgtagcggtgaaatgcgtagatattgggaagaacaccagtggcgaaggcgctcaactgggccgtaactgacactcagggacgaaagctagggtagcgaaagggattagatacccctgtagtcttagctgtaaacgatgaacactaggcgttgcttgtatcgacccgagcagtgccgtagccaacgcgttaagtgttccgcctggggagtacgcacgcaagtgtgaaactcaaaggaattgacgggggcccgcgacaagcggtggagtatgtggtttaattcgatgcaacgcgaagaaccttaccaggacttgacatctcgagaaggaggcgtaatagcttctgtgccttagggaactcgaagacaggtggtgcatggctgtcgtcagctcgtgtcgtgagatgttgggttaagtcccgcaacgagcgcaaccctcattcttagttgccagcattaagttgggcactttaggaagactgccggtgacaaaccggaggaaggtggggatgacgtcaagtcagcatgccccttacgttctgggctacacacgtactacaatggtggggacaaagggcagcaagcgagcgatcgtaagcgaatctcagcaaaccccgcctcagttcagattgcaggctgcaactcgcctgcatgaaggaggaatcgctagtaatcgcaggtcagcatactgcggtgaattcgttcccgggccttgtacacaccgcccgtcacaccatggaagttggccacgcccgaagtcgttaccctaaccgcttatgtggagggggatgccgaaggcagggctggtgactagggtgaagtcgtaacaaggtagccgtaccggaaggtgtggctggatcacctccttat

SEQ ID NO: 6799 - DNA, 1381 bp, Pokkaliibacter plantistimulans
  ref <308>: DATABASE ACCESSION NUMBER: NCBI ACCESSION: NZ_LAPT01000083.1
  ref <309>: DATABASE ENTRY DATE: 2019-04-01
  ref <313>: RELEVANT RESIDUES IN SEQ ID NO: (1)..(1381)
gccactacataccgcatacgtcctaagggagaaagcaggggatcttcggaccttgcgctatcagatgagcctgcgtgggattagctagttggtagggtaaaggcctaccaaggcgacgatccctagctggtctgagaggatgatcagccacactgggactgagacacggcccagactcctacgggaggcagcagtggggaatattggacaatgggggcaaccctgatccagccatgccgcgtgtgtgaagaaggccttcgggttgtaaagcactttcagtggtgaggaaggggtgatggctaatatccatcatcattgacgctagccacagaagaagcaccggctaactccgtgccagcagccgcggtaatacggagggtgcaagcgttaatcggaattactgggcgtaaagcgcgcgtaggcggtttgataagcggagtgtgaaatccccgggcttaacctgggcacggcattccgaactgtcaggctagagtgcggtagagggtggtggaatttcctgtgtagcggtgaaatgcgtagatataggaaggaacatcagtggcgaaggcgaccacctggactgacactgacgctgaggtgcgaaagcgtggggagcaaacaggattagataccctggtagtccacgccgtaaacgatgtcgactagccgtcgggtcccttgctggacttggtggcgaagctaacgcgataagttgaccgcctggggagtacggccgcaaggttaaaactcaaatgaattgacgggggcccgcacaagcggtggagcatgtggtttaattcgaagcaacgcgaagaaccttacctggccttgacatccagagaatcctgcagagatgcgggagtgccttcgggagctctgagacaggtgctgcatggctgtcgtcagctcgtgttgtgaaatgttgggttaagtcccgtaacgagcgcaacccttgcccttatttgccagcacttcgggtgggaactctaaggggactgccggtgacaaaccggaggaaggtggggatgacgtcaagtcatcatggcccttacggccagggctacacacgtgctacaatggaccgtacaaagggttgcgagctagcgatagtgagctaatcccaaaaaacggttcgtagtccggattggagtctgcaactcgactccatgaagtcggaatcgctagtaatcgcagatcagcatgctgcggtgaatacgttcccgggccttgtacacaccgcccgtcacaccatgggagtggattgcaccagaagtagctagtttaaccttcgggaggacggttaccacggtgtggttcatgactggggtgaagtcgtaacaaggtaaccgtaggggaacctgcggttggatcacctccttaa

SEQ ID NO: 6800 - DNA, 1531 bp, Polaromonas sp. SP1
  ref <308>: DATABASE ACCESSION NUMBER: NCBI ACCESSION: NZ_CP031013.1
  ref <309>: DATABASE ENTRY DATE: 2019-04-01
  ref <313>: RELEVANT RESIDUES IN SEQ ID NO: (1)..(1531)
aactatagagtttgatcctggctcagattgaacgctggcggcatgccttacacatgcaagtcgaacggtagagtagcaatactcgagagtggcgaacgggtgagtaatatatcggaacgtgcccaatcgtgggggataacgtagagaaatttacgctaataccgcatacgatctaaggatgaaagcgggggatcgcaagacctcgcgcgattggagcggctgatatcagattaggttgttggtgaggtaaaagctcaccaagccgacgatctgtagctggtttgagagaacgaccagccacactgggactgagacacggcccagactcctacgggaggcagcagtggggaattttggacaatgggcgaaagcctgatccagcaatgccgcgtgcaggaagaaggccttcgggttgtaaactgcttttgtacggaacgaaacggccttttctaataaagagggctaatgacggtaccgtaagaataagcaccggctaactacgtgccagcagccgcggtaatacgtagggtgcgagcgttaatcggaattactgggcgtaaagcgtgcgcaggcggttatataagacagttgtgaaatccccgggctcaacctgggaattgcatctgtgactgtatagctggagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtgcattagtactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtagggctacacacgtcatacaatggctggtacagagggttgccaacccgcgagggggagctaatcccataaaaccagtcgtagtccggatcgtagtctgcaactcgactacgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 6801 - DNA, 1536 bp, Polaromonas sp. YR568
  ref <308>: DATABASE ACCESSION NUMBER: NCBI ACCESSION: NZ_FPBM01000011.1
  ref <309>: DATABASE ENTRY DATE: 2019-04-01
  ref <313>: RELEVANT RESIDUES IN SEQ ID NO: (1)..(1536)
gattaaactatagagtttgatcctggctcagattgaacgctggcggcatgccttacacatgcaagtcgaacggtagagtagcaatactcgagagtggcgaacgggtgagtaatatatcggaacgtgcccaatcgtgggggataacgtagagaaatttacgctaataccgcatacgatctaaggatgaaagcgggggatcgcaagacctcgcgcgattggagcggctgatatcagattaggttgttggtgaggtaaaagctcaccaagccgacgatctgtagctggtttgagagaacgaccagccacactgggactgagacacggcccagactcctacgggaggcagcagtggggaattttggacaatgggcgaaagcctgatccagcaatgccgcgtgcaggaagaaggccttcgggttgtaaactgcttttgtacggaacgaaacggctctttctaataaagagggctaatgacggtaccgtaagaataagcaccggctaactacgtgccagcagccgcggtaatacgtagggtgcgagcgttaatcggaattactgggcgtaaagcgtgcgcaggcggttatataagacagttgtgaaatccccgggctcaacctgggaattgcatctgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtgcattagtactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtagggctacacacgtcatacaatggctggtacagagggttgccaacccgcgagggggagctaatcccataaaaccagtcgtagtccggatcgtagtctgcaactcgactacgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 6802 - DNA, 1498 bp, Polymorphum gilvum
  ref <308>: DATABASE ACCESSION NUMBER: NCBI ACCESSION: NC_015259.1
  ref <309>: DATABASE ENTRY DATE: 2019-04-01
  ref <313>: RELEVANT RESIDUES IN SEQ ID NO: (1)..(1498)
cttttgtttaacctgagagtttgatcctggctcagaacgaacgctggcggcaggcttaacacatgcaagtcgaacggtctcttcggaggcagtggcagacgggtgagtaacgcgtgggaacatacctttcggtacggaacaacagttggaaacgactgctaataccgtatacgccctatgggggaaagatttatcgccgagagattggcccgcgtcggattagctagttggtggggtaatggcccaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaacctcggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcagggtgcatgcatcttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgtgttacattcagagatggatggtcttcttcggaagcgcggagacaggtgctgcatggctgtcgtcagctcgtgtcgtgagatgttgggttaagtcccgcaacgagcgcaaccctcgcccctagttgccagcatttggttgggcactctagggggactgccggtgataagccgagaggaaggtggggatgacgtcaagtcctcatggcccttacgggctgggctacacacgtgctacaatggcggtgacaatgggcagcgaaggggcgacccggagctaatctcaaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggctttacccgaaggtggtgcgctaaccgcaaggaggcagccaaccacggtagggtcagcgactggggtgaagtcgtaacaaggtagccgtaggggaacctgcggctggatcacctcctttctaagga

SEQ ID NO: 6803 - DNA, 1538 bp, Polynucleobacter hirudinilacicola
  ref <308>: DATABASE ACCESSION NUMBER: NCBI ACCESSION: NZ_NAIA01000001.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggtgcttgcacctggtggcgagtggcgaacgggtgagtaatacatcggaacgtaccttatcgtgggggataacgcagcgaaagctgtgctaataccgcatacgccctgagggggaaagcgggggatcgaaagacctcgcgcgattagagcggccgatgcctgattagcttgttggtggggtaaaagcccaccaaggcgacgatcagtagctggtctgagaggacgatcagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacaccggctctaacacagtccgggaatgacggtacctgaagaataagcaccggctaactacgtgccagcagccgcggtaatacgtagggtgcgagcgttaatcggaattactgggcgtaaagcgtgcgcaggcggttatacaagacaggcgtgaaatccccgggcttaacctgggaatggcgcctgtgactgtatagctagagtgtgtcagaggggggtagaattccacgtgtagcagtgaaatgcgtagatatgtggaggaataccaatggcgaaggcagccccctgggataacactgacgctcatgcacgaaagcgtggggagcaaacaggattagataccctggtagtccacgccctaaacgatgctgactagttgttcgggatttacatcctgagtaacgtagctaacgcgtgaagtcagccgcctggggagtacggtcgcaagattaaaactcaaaggaattgacggggacccgcacaagcggtggatgatgtggattaattcgatgcaacgcgaaaaaccttacctacccttgacatgtcactaacgaagtagagatacattaggtgctcgtaagagaaagtgaacacaggtgctgcatggctgtcgtcagctcgtgtcgtgagatgttgggttaagtcccgcaacgagcgcaacccttgtctttagttgctacgcaagagcactctaaagagactgccggtgacaaaccggaggaaggtggggatgacgtcaagtcctcatggcccttatgggtagggcttcacacgtcatacaatggtgcatacagagggttgccaacccgcgagggggagctaatctcagaaaatgcatcgtagtccggatcgtagtctgcaactcgactacgtgaagctggaatcgctagtaatcgcggatcagaatgtcgcggtgaatacgttcccgggtcttgtacacaccgcccgtcataccatgggagtgggttttgccagaagccgttagcctaaccgcaaggagggcgactgccacggcagggttcatgactggggtaaagtcgtaacaaggtagccgtatcggaaggtgcggctggatcacctcctttct

SEQ ID NO: 6804 - DNA, 1472 bp, Pontibaca methylaminivorans
  ref <308>: DATABASE ACCESSION NUMBER: NCBI ACCESSION: NZ_FTPS01000001.1
  ref <309>: DATABASE ENTRY DATE: 2019-04-01
  ref <313>: RELEVANT RESIDUES IN SEQ ID NO: (1)..(1472)
tcaacttgagagtttgatcctggctcagaacgaacgctggcggcaggcctaacacatgcaagtcgaacgaagccttcgggcttagtggcggacgggttagtaacgcgtgggaacgtgcccttctctacggaatagtcccgggaaactgggggtaataccgtatacgcccttcgggggaaagatttatcggagaaggatcggcccgcgttagattagatagttggtggggtaacggcctaccaagtctacgatctatagctggtttgagaggatgatcagcaacactgggactgagacacggcccagactcctacgggaggcagcagtggggaatcttggacaatgggggaaaccctgatccagccatgccgcgtgagtgacgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgcacgtaggcggatcagcaagttaggggtgaaatcccggggctcaaccccggaactgcctctaaaactgttggtcttgagttcgagagaggtgagtggaattccgagtgtagaggtggaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagcttgctgttcggtgacacacctaacggattaagcattccgcctggggagtacgatcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcaggtcaagctgggcactctaaagaaaccgcccgtgataagcgggaggaaggtgtggatgacgtcaagtcctcatggcccttacgggttgggctacacacgtgctacaatggtggtgacagtgggttaatccccaaaaaccatctcagttcggattggggtctgcaactcgaccccatgaagtcggaatcgctagtaatcgcggaacagcatgccgcggtgaatacgttcccgggccttgtacacaccgcccgtcacaccatgggagttgggcccacccgaaggcggtgcgccaacctcgcaagaggaggtagccgaccacggtgagctcagcgactggggtgaagtcgtaacaaggtagccgtaggggaacctgcggctggatcacctcctttctaa

SEQ ID NO: 6805 - DNA, 1356 bp, Pontibacillus chungwhensis
  ref <308>: DATABASE ACCESSION NUMBER: NCBI ACCESSION: NZ_AVBG01000031.1
  ref <309>: DATABASE ENTRY DATE: 2019-04-01
  ref <313>: RELEVANT RESIDUES IN SEQ ID NO: (1)..(1356)
tcactggtaaaaggcggtttcggccgtcactcatggatgggcccgcggcgcattagctagttggtaaggtaacggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccagaggaaatgctggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacagctcaactgtggagggccattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtgggtagcaaacaggattagataccctggtagtccacgccgtaaacgttgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttccgctatccctagagatagggagttcccttcggggacggaatgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacagagggccgcgagaccgcgaggtcaagcaaatctcaaaaaaccattctcagttcggattgcaggctgcaactcgcctgtatgaagccggaatcgctagtaatcgcaggtcagcatactgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 6806 - DNA, 1473 bp, Pontibacillus halophilus
  ref <308>: DATABASE ACCESSION NUMBER: NCBI ACCESSION: NZ_AVPE01000043.1
  ref <309>: DATABASE ENTRY DATE: 2019-04-01
  ref <313>: RELEVANT RESIDUES IN SEQ ID NO: (1)..(1473)
tttatggagagtttgatcctggctcaggacgaacgctggcggcgtgcctaatacatgcaagtcgagcgcaggaagcaacatgatcccttcggggtgattgttgtggaatgagcggcggacgggtgagtaacacgtgggtaacctacccacaagatcgggataactccgggaaaccggggctaataccgaataatcctttgaaccgcatggttcagaggtaaaagacggtttcggctgtcacttgtggatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccagagtaactgctggtaccttgacggtacctaaccagaaagccccggctaactacgtgccagcagccgcggtaatacgtagggggcaagcgttgtccggaattattgggcgtaaagcgcgcgcaggcggttccttaagtctgatgtgaaaggccacggctcaaccgtggaaggccattggaaactggggaacttgagtgcagaagaggagagtggaattccaagtgtagcggtgaaatgcgtagatatttggaggaacaccagtggcgaaggcgactctctggtctgcaactgacgctgaggcgcgaaagcgtgggtagcaaacaggattagataccctggtagtccacgccgtaaacgatgagtgctaggtgttagggggtttccgccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcttgtgctatccctagagatagggagttcccttcggggacacaatgacaggtggtgcatggttgtcgtcagctcgtgtcgtgagatgttgggttaagtcccgcaacgagcgcaacccctaatcttagttgccagcatttagttgggcactctaaggtgactgccggtgacaaaccggaggaaggcggggatgacgtcaaatcatcatgccccttatgacctgggctacacacgtgctacaatggatggtacagagggctgcgagaccgcgaggtcaagcgaatctcaaaaaaccattctcagttcggattgcaggctgcaactcgcctgtatgaagccggaatcgctagtaatcgcaggtcagcatactgcggtgaatacgttcccgggccttgtacacaccgcccgtcacaccacgagagttggcaacacccgaagtcggtgaggtaacctttt

SEQ ID NO: 6807 - DNA, 961 bp, Pontibacillus litoralis
  ref <308>: DATABASE ACCESSION NUMBER: NCBI ACCESSION: NZ_AVPG01000063.1
  ref <309>: DATABASE ENTRY DATE: 2019-04-01
  ref <313>: RELEVANT RESIDUES IN SEQ ID NO: (1)..(961)
tttggagagtttgatcctggctcaggacgaacgctggcggcgtgcctaatacatgcaagtcgagcgcatgaatctacaagattccttcgggatgattgtagtggattgagcggcggacgggtgagtaacacgtgggtaacctgccttcgagattgggataactccgggaaaccggggctaataccgaataacacatgaaaccgcatggtttcgtgataaaaggcggcttcggccgtcactcgaagatggacccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtgccataggaaatgatggcaccttgacggtacctaaccagaaagccccggctaactacgtgccagcagccgcggtaatacgtagggggcaagcgttgtccggaattattgggcgtaaagcgcgcgcaggcggttccttaagtctgatgtgaaagcccacggctcaaccgtggatggccattggaaactggggaacttgagtacagaagaggagagtggaattccacgtgtagcggtgaaatgcgtagagatgtggaggaacaccagtggcgaaggcgactctctggtctgtaactgacgctgaggcgcgaaagcgtgggtagcaaacaggattagataccctggtagtccacgccgtaaacgatgagtgctaggtgttagggggtttccgccccttagtgctgcagttaacgcattaagcactccgcctggggagtacggccgcaaggctgaaactcaaaggaattgacgggggcccgcacaagcgg

SEQ ID NO: 6808 - DNA, 1548 bp, Pontibacillus marinus
  ref <308>: DATABASE ACCESSION NUMBER: NCBI ACCESSION: NZ_AVPF01000156.1
  ref <309>: DATABASE ENTRY DATE: 2019-04-01
  ref <313>: RELEVANT RESIDUES IN SEQ ID NO: (1)..(1548)
tggctcaggacgaacgctggcggcgtgcctaatacatgcaagtcgagcgcgtgaaacaacatgatcccttcggggtgattgttgtggatcgagcggcggacgggtgagtaacacgtgggtaacctacctgagagatcgggataaccccgggaaaccggggctaataccgaataatcgttggaaccgcatggttccaacgtaaaaggcggcttttgccgtcactttcagatggacccgcggcgcattagctagttggtaaggtaacggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccagaggaaatgctggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacagctcaactgtggagggccattggaaactggggaacttgagtacagaagaggagagcggaattccacgtgtagcggtgaaatgcgtagatatgtggaggaacaccagtggcgaaggcggctctctggtctgtaactgacgctgaggcgcgaaagcgtgggtagcaaacaggattagataccctggtagtccacgccgtaaacgttgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttccgctatccctagagatagggagttcccttcggggacggaatgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacagagggcagcgagaccgcgaggtcaagcaaatctcaaaaaaccattctcagttcggattgcaggctgcaactcgcctgtatgaagccggaatcgctagtaatcgcaggtcagcatactgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 6809 - DNA, 617 bp, Pontibacillus yanchengensis
  ref <308>: DATABASE ACCESSION NUMBER: NCBI ACCESSION: NZ_AVBF01000136.1
  ref <309>: DATABASE ENTRY DATE: 2019-04-01
  ref <313>: RELEVANT RESIDUES IN SEQ ID NO: (1)..(617)
ctgccgtcactcgaagatggatccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtgccagaggaaatgctggcaccttgacggtacctaaccagaaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggccattggaaactggggagcttgagtacagaagaggagagtggaattccacgtgtagcggtgaaatgcgtagatatgtggaggaacaccagtggcgaaggcgactctctggtctgtaactgacgctgaggcgcgaaagcgtgggtagcaaacaggattagataccctggtagtccacgccgtaaacgttgagtgcta

SEQ ID NO: 6810 - DNA, 1521 bp, Pontibacter actiniarum
  ref <308>: DATABASE ACCESSION NUMBER: NCBI ACCESSION: NZ_CP021235.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacggatcaggttccttcggggacctggttagtggcgcacgggtgcgtaacgcgtatgcaacctaccttccacagggggatagcccggagaaatccggattaataccgcatgtgaccacgagagggcatccgaccgtggtaaaagcttcggcggtggaagatgggcatgcgtgccattagctagatggcggggtaacggcccaccatggctacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttgtatgggaagaaaacgcccctgcgggggtaactgacggtaccatgcgaataagcaccggctaactccgtgccagcagccgcggtaatacggagggtgcaagcgttgtccggatttattgggtttaaagggtgcgtaggcggcccgttaagtcagcggtgaaatcccacggctcaaccgtggaactgccgttgatactggcgggcttgagttcggtcgaggcgggcggaactggcggtgtagcggtgaaatgcttagataccgccaagaaccccgattgcgtaggcagctcgctgggccgaaactgacgctgaggcacgaaagcgtggggagcgaacaggattagataccctggtagtccacgccgtaaacgatgatgactcgatgttggcgatacactgtcagcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgaccgctccagagatggagcctcccttcggggcacaaagcaaggtgctgcatggccgtcgtcagctcgtgccgtgaggtgttgggttaagtcccgcaacgagcgcaacccctatcttcagttgccagcacatcatggtggggactctggagagactgcctccgcaaggagcgaggaaggcggggacgacgtcaggtcatcatggcccttacgcctagggctacacacgtgctacaatggccggtacagagggttgccacccagcgatggggcgccaatctcaaaaagccggtctcagttcggatcggagtctgcaactcgactccgtgaagccggaatcgctagtaatcgcgtatcagcaacgacgcggtgaatacgttcccgggccttgtacacaccgcccgtcaagccatggaagtcagggagacctgaagccggtgacctcaaaggagccgtctagggtaaaactggtaactggggctaagtcgtaacaaggtagccgtaccggaaggtgcggctggatcacctcctttcta

SEQ ID NO: 6811 - DNA, 1522 bp, Pontibacter akesuensis
  ref <308>: DATABASE ACCESSION NUMBER: NCBI ACCESSION: NZ_FPCA01000016.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacggatcaggttctttcgggaacctggttagtggcgcacgggtgcgtaacgcgtatgcaacctaccttccacagggggatagccccgggaaaccgggattaataccgcatgacaccatgaatcggcatcggtttatggtcaaagtttcggcggtggaagatgggcatgcgtgccattagctagttggcggggtagaggcccaccaaggctacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttatcagggaagaaaacgcccctgcgggggtaactgacggtacctgatgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtgaaggcgggcggaactggcggtgtagcggtgaaatgcttagataccgccaagaaccccgattgcgtaggcagctcgctgtgccgaaactgacgctgaggcacgaaagcgtggggagcgaacaggattagataccctggtagtccacgccgtaaacgatgattactcgatgttggcgatacactgtcagcgtccaagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccagagatggtacttcccttcggggcacaaagcaaggtgctgcatggccgtcgtcagctcgtgccgtgaggtgttgggttaagtcccgcaacgagcgcaacccctatcttcagttgccagcacgtgatggtggggactctggagagactgcctccgcaaggagcgaggaaggcggggacgacgtcaggtcatcatggcccttacgcctagggctacacacgtgctacaatggcgcatacagagggtagccagccagcgatggtgagccaatcccagaaagtgcgtctcagttcggatcggagtctgcaactcgactccgtgaagccggaatcgctagtaatcgcgtatcagcaacgacgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttcta

SEQ ID NO: 6812 - DNA, 1522 bp, Pontibacter diazotrophicus
  ref <308>: DATABASE ACCESSION NUMBER: NCBI ACCESSION: NZ_QRGR01000064.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacggactggagaccttcgggtttccagttagtggcgcacgggtgcgtaacgcgtatgcaacctaccttctattgggggatagcccaccgaaaggtggattaataccgcataacaccatgacatggcatcatgttacggttaaagtttcggcgatagaagatgggcatgcgtgccattagctagttggcggggtaaaggcccaccaaggcgacgatggctaggggttctgagaggatggtcccccacactggtactgagacacggaccagactcctacgggaggcagcagtagggaatattgggcaatgggcgagagcctgacccagccatgccgcgtgcaggaagaaggccttctgggttgtaaactgcttttaccagggaagaaaacgctcctgcgggagtaactgacggtacctggtgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtcgaggcgggcggaactggtggtgtagcggtgaaatgcttagataccaccaagaaccccgattgcgtaggcagctcgcttggccgaaactgacgctgaggcacgaaagcgtggggagcgaacaggattagataccctggtagtccacgccgtaaacgatgatgactcgatgttggcgatacactgtcagcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgacaggcccagagatgggccctcccttcggggcacaaagcaaggtgctgcatggctgtcgtcagctcgtgccgtgaggtgttgggttaagtcccgcaacgagcgcaacccctgtctttagttgccagcacgtaatggtggggactctaaagagactgccttcgcaagaagtgaggaaggcggggacgacgtcaagtcatcatggcccttacgcctagggctacacacgtgctacaatggccggtacagagggtcgccacctagtgatagggcgccaatctcaaaaagccggtctcagttcggatcggagtctgcaactcgactccgtgaagccggaatcgctagtaatcgcgtatcagcaacgacgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttcta

SEQ ID NO: 6813 - DNA, 1527 bp, Pontibacter indicus
  ref <308>: DATABASE ACCESSION NUMBER: NCBI ACCESSION: NZ_FTPP01000008.1
  ref <309>: DATABASE ENTRY DATE: 2019-04-01
  ref <313>: RELEVANT RESIDUES IN SEQ ID NO: (1)..(1527)
acaatggagagtttgatcctggctcaggatgaacgctagcggcaggcctaatacatgcaagtcgaacggaccttgctctttcgggagcttggttagtggcgcacgggtgcgtaacgcgtatgcaacctaccttccactgggggatagcccaccgaaaggtggattaataccgcatatgaccacgagagggcatccgaccgtggtaaaagctgaggcggtggaagatgggcatgcgtgccattagctagttggcggggtagaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttgtacgggaagaaaacgcccctgcgggggtaactgacggtaccgtacgaataagcaccggctaactccgtgccagcagccgcggtaatacggagggtgcaagcgttgtccggatttattgggtttaaagggtgcgtaggcggcccgttaagtcagcggtgaaatcccggggctcaaccccggaactgccgttgatactggcgggcttgagttcggtcgaggcgggcggaactggtggtgtagcggtgaaatgcatagataccaccaagaaccccgattgcgaaggcagctcgctgggccgaaactgacgctgaggcacgaaagcgtggggagcgaacaggattagataccctggtagtccacgccgtaaacgatgatgactcgatgtttgcgatacacggcaagcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgaccggtccagagatggaccttcccttcggggcacaaagcaaggtgctgcatggctgtcgtcagctcgtgccgtgaggtgttgggttaagtcccgcaacgagcgcaacccctacctttagttgccagcgggtcatgccggggactctaaagggactgccttcgcaagaagcgaggaaggcggggacgacgtcaagtcatcatggcccttacgcctagggctacacacgtgctacaatggccggtacagagggttgccacctggtgacagggagccaatctcaaaaagccggtctcagttcggatcggagtctgcaactcgactccgtgaagccggaatcgctagtaatcgcgcatcagcaacggcgcggtgaatacgttcccgggccttgtacacaccgcccgtcaagccatggaagtcagggagacctgaagccggtgaccgtcacaggagccgtctagggtaaaactggtaactggggctaagtcgtaacaaggtagccgtaccggaaggtgcggctggatcacctcctttctag

SEQ ID NO: 6814 - DNA, 1530 bp, Pontibacter korlensis
  ref <308>: DATABASE ACCESSION NUMBER: NCBI ACCESSION: NZ_CP009621.1
  ref <309>: DATABASE ENTRY DATE: 2019-04-01
  ref <313>: RELEVANT RESIDUES IN SEQ ID NO: (1)..(1530)
ttacaatggagagtttgatcctggctcaggatgaacgctagcggcaggcctaatacatgcaagtcgaacggatcagagggcttcggttctctggttagtggcgcacgggtgcgtaacgcgtatgcaacctaccttccactgggggatagcccggggaaacccggattaataccgcatgtgaccactgagagggcatccgatcgtggtaaaagctgaggcggtggaagatgggcatgcgtgccattagctagttggcggggtaacggcccaccaaggctacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttatctgggaagaaaacgcccctgcgggggtaactgacggtaccagatgaataagcaccggctaactccgtgccagcagccgcggtaatacggagggtgcaagcgttgtccggatttattgggtttaaagggtgcgtaggcggcccgttaagtcagcggtgaaatcccacggctcaaccgtggaactgccgttgatactggcgggcttgagttcggtcgaggcgggcggaactggtggtgtagcggtgaaatgcttagataccaccaagaaccccgattgcgtaggcagctcgctgggccgaaactgacgctgaggcacgaaagcgtggggagcgaacaggattagataccctggtagtccacgccgtaaacgatgatgactcgatgttggcgatacactgtcagcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgaccgcaccagagatggtgcttcccttcggggcacaaagcaaggtgctgcatggctgtcgtcagctcgtgccgtgaggtgttgggttaagtcccgcaacgagcgcaacccctacctttagttgccagcgcgtcatggcggggactctaaagggactgccttcgcaagaagcgaggaaggcggggacgacgtcaagtcatcatggcccttacgcctagggctacacacgtgctacaatggccggtacagagggttgccacccagcgatggggcgccaatctcaaaaagccggtctcagttcggatcggagtctgcaactcgactccgtgaagccggaatcgctagtaatcgcgtatcagcaacgacgcggtgaatacgttcccgggccttgtacacaccgcccgtcaagccatggaagtcagggagacctgaagccggtgaccgttataggagccgtctagggtaaaactggtaactggggctaagtcgtaacaaggtagccgtaccggaaggtgcggctggatcacctcctttctag

SEQ ID NO: 6815 - DNA, 1527 bp, Pontibacter lucknowensis
  ref <308>: DATABASE ACCESSION NUMBER: NCBI ACCESSION: NZ_FTNM01000009.1
  ref <309>: DATABASE ENTRY DATE: 2019-04-01
  ref <313>: RELEVANT RESIDUES IN SEQ ID NO: (1)..(1527)
acaatggagagtttgatcctggctcaggatgaacgctagcggcaggcctaatacatgcaagtcgaacggatctgattccttcgggaatcaggttagtggcgcacgggtgcgtaacgcgtatgcaacctaccttccactgggggatagcccaccgaaaggtggattaataccgcatatgaccacgagagggcatccgaccgtggtaaaagctgaggcggtggaagatgggcatgcgtgccattagctagttggcggggtaaaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttaccagggaagaaaacgcgcctgcgggcgtaactgacggtacctggtgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtcgaggcgggcggaactggtggtgtagcggtgaaatgcatagataccaccaagaaccccgattgcgaaggcagctcgctggcccgaaactgacgctgaggcacgaaagcgtggggagcgaacaggattagataccctggtagtccacgccgtaaacgatgatcactcgatgtttgcgatacacggcaagcgtccaagcgaaagcgttaagtgatccacctggggagtacgcccgcaagggtgaaactcaaaggaattgacgggggcccgcacaagcggtggagcatgtggtttaattcgatgatacgcgaggaaccttacctaggctagaatgcgcgtgaccggtccagagatggaccttcccttcggggcacaaagcaaggtgctgcatggctgtcgtcagctcgtgccgtgaggtgttgggttaagtcccgcaacgagcgcaacccctacctttagttgccagcgtgttatgacggggactctaaagggactgcctccgcaaggagcgaggaaggcggggacgacgtcaagtcatcatggcccttacgcctagggctacacacgtgctacaatggccggtacagagggttgccacctggtgacagggagccaatctcaaaaagccggtctcagttcggatcgaagtctgcaactcgacttcgtgaagccggaatcgctagtaatcgcgtatcagcaacgacgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttctag

SEQ ID NO: 6816 - DNA, 1526 bp, Pontibacter mucosus
  ref <308>: DATABASE ACCESSION NUMBER: NCBI ACCESSION: NZ_QBKI01000020.1
  ref <309>: DATABASE ENTRY DATE: 2019-04-01
  ref <313>: RELEVANT RESIDUES IN SEQ ID NO: (1)..(1526)
acaatggagagtttgatcctggctcaggatgaacgctagcggcaggcctaatacatgcaagtcgaacgaatctgaggacttcggttctcaggttagtggcgcacgggtgcgtaacgcgtatgcaacctaccttccactgggggatagccctccgaaagggggattaataccgcatgacacaatagagtggcatcactttattgtcaaagctgaggcggtggaagatgggcatgcgtgccattagctagttggcggggtagaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttaccagggaagaaaacgcccccgcgggggtaactgacggtacctggtgaataagcaccggctaactccgtgccagcagccgcggtaatacggagggtgcgagcgttgtccggatttattgggtttaaagggtgcgtaggcggcccgttaagtcagcggtgaaatcccacggctcaaccgtggaactgccgttgatactggcgggcttgagttcggtcgaggcgggcggaactggtggtgtagcggtgaaatgcttagataccaccaagaaccccgattgcgtaggcagctcgctgggccgaaactgacgctgaggcacgaaagcgtggggagcgaacaggattagataccctggtagtccacgccgtaaacgatgatgactcgatgtcggcgacacacggtcggcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgaccgctccagagatggagcttcccttcggggcacaaagcaaggtgctgcatggctgtcgtcagctcgtgccgtgaggtgttgggttaagtcccgcaacgagcgcaacccctacctttagttgccagcgcgtcatggcggggactctaaagggactgccttcgcaagaagcgaggaaggcggggacgacgtcaagtcatcatggcccttacgcctagggctacacacgtgctacaatggccggtacagagggtcgccacccagcgatggggcgccaatctcaaaaagccggtctcagttcggatcggagtctgcaactcgactccgtgaagccggaatcgctagtaatcgcgcatcagcaatggcgcggtgaatacgttcccgggccttgtacacaccgcccgtcaagccatggaagtcagggagacctgaagccggtgaccgtcataggagccgtctagggtaaaactggtgactggggctaagtcgtaacaaggtagccgtaccggaaggtgcggctggatcacctcctttcta

SEQ ID NO: 6817 - DNA, 1522 bp, Pontibacter ramchanderi
  ref <308>: DATABASE ACCESSION NUMBER: NCBI ACCESSION: NZ_PJMU01000007.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacggaccttgatctttcgggatcttggttagtggcgcacgggtgcgtaacgcgtatgcaacctaccttccactgggggatagcccaccgaaaggtggattaataccgcatgtgaccacgagagggcatccgaccgtggtaaaagccgaggcggtggaagatgggcatgcgtgccattagctagttggcggggtaaaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttatctgggaagaaaacgcccctgcgggggtaactgacggtaccagatgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtcgaggcgggcggaactggtggtgtagcggtgaaatgcatagataccaccaagaaccccgattgcgaaggcagctcgctggcccgaaactgacgctgaggcacgaaagcgtggggagcgaacaggattagataccctggtagtccacgccgtaaacgatgatcactcgatgtttgcgatacacggcaagcgtccaagcgaaagcgttaagtgatccacctggggagtacgcccgcaagggtgaaactcaaaggaattgacgggggcccgcacaagcggtggagcatgtggtttaattcgatgatacgcgaggaaccttacctaggctagaatgcgcgtgaccgccccagagatggggcttcccttcggggcacaaagcaaggtgctgcatggctgtcgtcagctcgtgccgtgaggtgttgggttaagtcccgcaacgagcgcaacccctacctttagttgccagcatgtaatgatggggactctaaagggactgcctccgcaaggagcgaggaaggcggggacgacgtcaagtcatcatggcccttacgcctagggctacacacgtgctacaatggccggtacagagggttgccacctggtgacagggagccaatctcaaaaagccggtctcagttcggatcgaagtctgcaactcgacttcgtgaagccggaatcgctagtaatcgcgcatcagcaacggcgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttcta

SEQ ID NO: 6818 - DNA, 1525 bp, Pontibacter roseus
  ref <308>: DATABASE ACCESSION NUMBER: NCBI ACCESSION: NZ_KB890763.1
  ref <309>: DATABASE ENTRY DATE: 2019-04-01
  ref <313>: RELEVANT RESIDUES IN SEQ ID NO: (1)..(1525)
acaatggagagtttgatcctggctcaggatgaacgctagcggcaggcctaatacatgcaagtcgaacgaatccagtgccttcgggtgctgggttagtggcgcacgggtgcgtaacgcgtatgcaacctaccttccactgggggatagcccggagaaatccggattaataccgcatgacaccacgagagggcatccgattgtggtcaaagccgaggcggtggaagatgggcatgcgtgccattagctagatggcggggtaacggcccaccatggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttatacgggaagaaaacgcccctgcgggggtaactgacggtaccgtatgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtcgaggcgggcggaactggtggtgtagcggtgaaatgcatagataccaccaagaaccccgattgcgtaggcagctcgctaggccgaaactgacgctgaggcacgaaagcgtggggagcgaacaggattagataccctggtagtccacgccgtaaacgatgagtactcgatgtttgcgatacactgtaagcgtccaagcgaaagcgttaagtactccacctggggagtacgcccgcaagggtgaaactcaaaggaattgacgggggcccgcacaagcggtggagcatgtggtttaattcgatgatacgcgaggaaccttacctaggctagaatgcgcgtgacagggccagagatggcccctcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagcgaggaaggcggggacgacgtcaagtcatcatggcccttacgcctagggctacacacgtgctacaatggccggtacagagggtcgccacccagcgatggggcgccaatctcaaaaagccggtctcagttcggatcggagtctgcaactcgactccgtgaagccggaatcgctagtaatcgcgcatcagcaacggcgcggtgaatacgttcccgggccttgtacacaccgcccgtcaagccatggaagtcagggagacctgaagccggtgaccgcaaggagccgtctagggtaaaactggtaactggggctaagtcgtaacaaggtagccgtaccggaaggtgcggctggatcacctcctttctag

SEQ ID NO: 6819 - DNA, 1522 bp, Pontibacter sp. 2b14
  ref <308>: DATABASE ACCESSION NUMBER: NCBI ACCESSION: NZ_QMDV01000007.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacgagatcaagagcttcggttcttggtttagtggcgcacgggtgcgtaacgcgtatgcaacctaccttctattgggggatagccttccgaaaggaagattaataccgcataacaccatgacctggcatcgggatatggttaaagctgaggcgatagaagatgggcatgcgtgccattagctagttggcggggtaacggcccaccaaggcgacgatggctaggggttctgagaggatggtcccccacactggtactgagacacggaccagactcctacgggaggcagcagtagggaatattgggcaatggtcgagagactgacccagccatgccgcgtgcaggatgaaggccttctgggttgtaaactgcttttatcagggaagaaaacgctcttgcgagagtaactgacggtacctgatgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagtttggttaaggcgggcggaactggtggtgtagcggtgaaatgcatagataccaccaagaaccccgattgcgtaggcagctcgctgggccaaaactgacgctgaggcacgaaagcgtggggagcgaacaggattagataccctggtagtccacgccgtaaacgatgaatactcgatgttagcgatacactgttagcgtccaagcgaaagcgttaagtattccacctggggagtacgcccgcaagggtgaaactcaaaggaattgacgggggcccgcacaagcggtggagcatgtggtttaattcgatgatacgcgaggaaccttacctaggctagaatgcgcgtgacagaagcagagatgcttccttccttcgggacacaaagcaaggtgctgcatggctgtcgtcagctcgtgccgtgaggtgttgggttaagtcccgcaacgagcgcaacccctatctttagttgccagcacgttatggtggggactctaaagagactgccttcgcaagaagtgaggaaggcggggacgacgtcaagtcatcatggcccttacgcctagggctacacacgtgctacaatggccggtacagagggtcgccacctagtgatagggcgccaatctcaaaaagccggtctcagttcggatcgaagtctgcaactcgacttcgtgaagccggaatcgctagtaatcgcgcatcagcaacggcgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttcta

SEQ ID NO: 6820 - DNA, 1527 bp, Pontibacter sp. BAB1700; identical to SEQ ID NO: 6815
  ref <308>: DATABASE ACCESSION NUMBER: NCBI ACCESSION: NZ_AKIS01000265.1
  ref <309>: DATABASE ENTRY DATE: 2019-04-01
  ref <313>: RELEVANT RESIDUES IN SEQ ID NO: (1)..(1527)

SEQ ID NO: 6821 - DNA, 1521 bp, Pontibacter sp. S10-8
  ref <308>: DATABASE ACCESSION NUMBER: NCBI ACCESSION: NZ_LVWA01000006.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacggatccagttccttcggggactgggttagtggcgcacgggtgcgtaacgcgtatgcaacctaccttccactgggggatagcccaccgaaaggtggattaataccgcatgacactacttgagggcatccgaaggtagtcaaagctgaggcggtggaagatgggcatgcgtgccattagctagttggcggggtagaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttaccagggaagaaaacgctcctgcgggagtaactgacggtacctggtgaataagcaccggctaactccgtgccagcagccgcggtaatacggagggtgcaagcgttgtccggatttattgggtttaaagggtgcgtaggcggcccgttaagtcagcggtgaaatcccacggctcaaccgtggaactgccgttgatactggcgggcttgagttcggtcgaggcgggcggaactggtggtgtagcggtgaaatgcttagataccaccaagaaccccgattgcgtaggcagctcgctgggccgaaactgacgctgaggcacgaaagcgtggggagcgaacaggattagataccctggtagtccacgccgtaaacgatgatgactcgatgttggcgatacactgtcagcgtccaagcgaaagcgttaagtcatccacctggggagtacgcccgcaagggtgaaactcaaaggaattgacgggggcccgcacaagcggtggagcatgtggtttaattcgatgatacgcgaggaaccttacctaggctagaatgcgcgtgaccgctccagagatggagcttcccttcggggcacaaagcaaggtgctgcatggctgtcgtcagctcgtgccgtgaggtgttgggttaagtcccgcaacgagcgcaacccctatcttcagttgccagcacatcatggtggggactctggagagactgcctccgcaaggagcgaggaaggcggggacgacgtcaagtcatcatggcccttacgcctagggctacacacgtgctacaatggccggtacagagggttgccacccagcgatggggcgccaatctcaaaaagccggtctcagttcggatcggagtctgcaactcgactccgtgaagccggaatcgctagtaatcgcgtatcagcaacgacgcggtgaatacgttcccgggccttgtacacaccgcccgtcaagccatggaagtcagggagacctgaagccggtgaccgtcaaggagccgtctagggtaaaactggtaactggggctaagtcgtaacaaggtagccgtaccggaaggtgcggctggatcacctcctttcta

SEQ ID NO: 6822 - DNA, 1522 bp, Pontibacter virosus
  ref <308>: DATABASE ACCESSION NUMBER: NCBI ACCESSION: NZ_QEKI01000029.1
  ref <309>: DATABASE ENTRY DATE: 2019-04-01
  ref <313>: RELEVANT RESIDUES IN SEQ ID NO: (1)..(1522)
tggagagtttgatcctggctcaggatgaacgctagcggcaggcctaatacatgcaagtcgaacggaccttgatctttcgggatcttggttagtggcgcacgggtgcgtaacgcgtatgcaacctaccttccactgggggatagcccggggaaacccggattaataccgcatatgaccacgggagggcatccgatcgtggtaaaagccgaggcggtggaagatgggcatgcgtgccattagctagttggcggggtaaaggcccaccaaggcgacgatggctaggggttctgagaggatggtcccccacactggtactgagacacggaccagactcctacgggaggcagcagtagggaatattgggcaatggccgagaggctgacccagccatgccgcgtgcaggaagaaggccttctgggttgtaaactgcttttaccagggaagaaaacgcgcctgcgggcgtaactgacggtacctggtgaataagcaccggctaactccgtgccagcagccgcggtaatacggagggtgcaagcgttgtccggatttattgggtttaaagggtgcgtaggcggcccgttaagtcagcggtgaaatcccagggctcaaccctggaactgccgttgatactggcgggcttgagttcggtcgaggcgggcggaactggtggtgtagcggtgaaatgcatagataccaccaagaaccccgattgcgaaggcagctcgctggcccgaaactgacgctgaggcacgaaagcgtggggagcgaacaggattagataccctggtagtccacgccgtaaacgatgattactcgatgtttgcgatacacggcaagcgtccaagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgaccggtccagagatggaccttcccttcggggcacaaagcaaggtgctgcatggctgtcgtcagctcgtgccgtgaggtgttgggttaagtcccgcaacgagcgcaacccctacctttagttgccagcatgtaatgatggggactctaaagggactgcctccgcaaggagcgaggaaggcggggacgacgtcaagtcatcatggcccttacgcctagggctacacacgtgctacaatggccggtacagagggtcgccacctggcaacagggcgccaatctcaaaaagccggtctcagttcggatcggagtctgcaactcgactccgtgaagccggaatcgctagtaatcgcgcatcagcaacggcgcggtgaatacgttcccgggccttgtacacaccgcccgtcaagccatggaagtcagggagacctgaagccggtgaccgtcaaaggagccgtctagggtaaaactggtaactggggctaagtcgtaacaaggtagccgtaccggaaggtgcggctggatcacctcctttcta

SEQ ID NO: 6823 - DNA, 1460 bp, Ponticaulis koreensis
  ref <308>: DATABASE ACCESSION NUMBER: NCBI ACCESSION: NZ_ATVJ01000005.1
  ref <309>: DATABASE ENTRY DATE: 2019-04-01
  ref <313>: RELEVANT RESIDUES IN SEQ ID NO: (1)..(1460)
tcaacttgagagtttgattctggctcagaacgaacgctggcggcaggcttaacacatgcaagtcgaacgatatagtggcagacgggtgagtaacgcgtggaaacgtgcctttcactacggaatagctccgggaaactggaattaataccgtatacgccctccgggggaaagatttatcggtgaaagatcggtccgcgttagattagatagttggtggggtaatggcctaccaagtctacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggacgataatgacggtacctagtaaagaagccccggctaacttcgtgccagcagccgcggtaatacgaagggggctagcgttgttcggaattactgggcgtaaagcgcgcgtaggcggactaacaagttggatgtgaaatcccagggctcaactctggaactgcattcaaaactgttagtctagaggccaggagaggtcagtggaataccgagtgtagaggtgaaattcgtagatattcggtggaacaccagtggcgaaggcgactgactggactggtactgacgctgaggtgcgaaagtgtggggagcaaacaggattagataccctggtagtccacaccgtaaacgatgaatgctagttgtctgcatgcatgcatgtaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccacgtttgacatgccctgtttgatcgatggagacatctttcttggttcgtccgcaggtgcacaggtgctgcatggctgtcgtcagctcgtgtcgtgagatgttgggttaagtcccgcaacgagcgcaaccctcacccttagttgccagcaggttaggctgggcactctaagggaactgccggtggcaagccggaggaaggtggggatgacgtcaagtcctcatggcccttacgcgtggggctacacacgtgctacaatggtagtgacaatgggataatcccaaaaaactatctcagttcggattgtcgtctgcaactcgacggcatgaagttggaatcgctagtaatcgtggatcagcatgccacggtgaatacgttcccgggccttgtacacaccgcccgtcacatcatgggagttggttctacccgaagactgtgtgctaacttcggaggcagcaggccacggtaggatcagtgactgggatgaagtcgtaacaaggtagccgtaggggaacctgcggctggatcacctcctttctaagg

SEQ ID NO: 6824 - DNA, 1467 bp, Ponticoccus sp. LZ-14
  ref <308>: DATABASE ACCESSION NUMBER: NCBI ACCESSION: NZ_RBVZ01000002.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgcaccttcgggtgagcggcggacgggttagtaacgcgtgggaacgtgcccttctctgcggaatagcctcgggaaactgagattaataccgcatacgcccttcgggggaaagatttatcggagaaggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggaaaccctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagttagaggtgaaatcccagggctcaaccctggaactgcctttaatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgttggggggcttgcccttcagtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggcatctacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctagtaatagggggcagctggccacggtaggctcagcgactggggtgaagtcgtaacaaggtagccgtaggggaacctgcggctggatcacctcctttctaa

SEQ ID NO: 6825 - DNA, 1467 bp, Pontivivens insulae
  ref <308>: DATABASE ACCESSION NUMBER: NCBI ACCESSION: NZ_OMKW01000007.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgcttccttcgggaagagcggcggacgggttagtaacgcgtgggaacgtgcctctctctacggaatagccattggaaacgatgaataataccgtatacgcccttcgggggaaagatttatcggagagagatcggcccgcgttagattagttagttggtggggtaacggcttaccaagacgacgatctatagctggtttgagaggatgatcagcaacactgggactgagacacggcccagactcctacgggaggcagcagtggggaatcttagacaatgggggcaaccctgatctagccatgccgcgtgagtgaagaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgtacgtaggcggaccgtaaagttgggggtgaaatcccggggctcaaccccggaactgcctccaaaactgccggtctagaggtcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggcagcttgctgttcggtgacgcagttaacgcattaagcattccgcctggggagtacggtcgcaagattaaaactcaaaggaattgacgggggcccgcacaagcggtggagcatgtggtttaattcgaagcaacgcgcagaaccttaccatcccttgacatcctgatcgcggaaccggagacggttctttcagttcggctggatcagtgacaggtgctgcatggctgtcgtcagctcgtgtcgtgagatgttgggttaagtcccgcaacgagcgcaaccctcgccgttagttgccagcatttagttgggcactctagcggaaccgccggtgataagccggaggaaggtggggatgacgtcaagtcctcatggcccttacgggatgggctacacacgtgctacaatggcagtgacaatgggttaatccccaaaagctgtctcagttcggattgtcctctgcaactcgagggcatgaagttggaatcgctagtaatcgcgtaacagcatgacgcggtgaatacgttcccgggccttgtacacaccgcccgtcacaccatgggagttgggtttacccgaaggtggtgcgccaaccgtaaggaggcagccaaccacggtaagctcagcgactggggtgaagtcgtaacaaggtagccctaggggaacctggggctggatcacctcctttctaa

SEQ ID NO: 6826 - DNA, 1491 bp, Porphyrobacter colymbi
  ref <308>: DATABASE ACCESSION NUMBER: NCBI ACCESSION: NZ_MUYK01000003.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggatgatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatccacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6827 - DNA, 1491 bp, Porphyrobacter cryptus
  ref <308>: DATABASE ACCESSION NUMBER: NCBI ACCESSION: NZ_KE383966.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgatcccttcggggatagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggccttttaagtcaggggtgaaatcccggggctcaaccccggaactgcccttgaaactgggaggctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggcttctggagacagattccttcccttcggggacctagagacaggtgctgcatggctgtcgtcagctcgtgtcgtgagatgttgggttaagtcccgcaacgagcgcaaccctcatccttagttgccatcattcagttgggcactttaaggaaactgccggtgataagccggaggaaggtggggatgacgtcaagtcctcatggcccttacaggctgggctacacacgtgctacaatggcaactacagtgggcagctatcccgcgagggtgcgctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6828 - DNA, 1491 bp, Porphyrobacter dokdonensis
  ref <308>: DATABASE ACCESSION NUMBER: NCBI ACCESSION: NZ_MUYI01000001.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcagaggtgaaatcccggggctcaaccccggaactgcctttgaaactgggaagctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcaactacagtgggcagctatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6829 - DNA, 1491 bp, Porphyrobacter donghaensis
  ref <308>: DATABASE ACCESSION NUMBER: NCBI ACCESSION: NZ_MUYG01000008.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgtaaggaggcagctgaccacggtgggttcagcgactggggtgaagtcgtaacaaggtagccgtaggggaacctgcggctggatcacctcctttctaagga

SEQ ID NO: 6830 - DNA, 1495 bp, Porphyrobacter mercurialis
  ref <308>: DATABASE ACCESSION NUMBER: NCBI ACCESSION: NZ_JTDN01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcgggataactcctcgaaaggggtgctaataccggatgatgtcttcggaccaaagatttatcgcctttagatgggcccgcgttggattagcttgttggtgaggtaaaggctcaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaaatactgggcgtaaagcgaacgtaggcggcttggcaagtcaggggtgaaatcccagtgctcaacactggaactgcctttgaaactgccaggcttgaatcctggagaggcgagtggaattccgagtgtagaggtgaaattcgtagatattcggaagaacaccagtggcgaaggcgactcgctggacaggtattgacgctgaggttcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctcggacgactaccggagacggttttcttcccttacgggaccgagtgacaggtgctgcatggctgtcgtcagctcgtgtcgtgagatgttgggttaagtcccgcaacgagcgcaaccctcgtccttagttgccatcattaagttgggaactctaaggaaaccgccggtgataagccggaggaaggtggggatgacgtcaagtcctcatggcccttacaggctgggctacacacgtgctacaatggcatctacagtgggcagctaactcgcaagggtgcgctaatctccaaaagatgtctcagttcggattgtcctctgcaactcgagggcatgaaggcggaatcgctagtaatcgcggatcagcacgccgcggtgaatacgttcccaggccttgtacacaccgcccgtcacgccatgggagttggttctacccgaaggtggtgcgctaacccgcaagggaggcagccaaccacggtgggatcagcgactggggtgaagtcgtaacaaggtagccgtaggggaacctgcggctggatcacctcctttctaagga

SEQ ID NO: 6831 - DNA, 1491 bp, Porphyrobacter neustonensis
  ref <308>: DATABASE ACCESSION NUMBER: NCBI ACCESSION: NZ_CP016033.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggataatgtcttcggaccaaagatttatcgcctttagatgggcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggctcatagagtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6832 - DNA, 1493 bp, Porphyrobacter sanguineus
  ref <308>: DATABASE ACCESSION NUMBER: NCBI ACCESSION: NZ_FRDF01000003.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataacagtgagaaattactgctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactggggatgataatgacagtacccagagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6833 - DNA, 1493 bp, Porphyrobacter sp. AAP60
  ref <308>: DATABASE ACCESSION NUMBER: NCBI ACCESSION: NZ_LJHV01000014.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataacagtgagaaattactgctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactggggatgataatgacagtacccagagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 6834 - DNA, 1491 bp, Porphyrobacter sp. AAP82
  ref <308>: DATABASE ACCESSION NUMBER: NCBI ACCESSION: NZ_ANFX01000029.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggcttctggagacagattccttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6835 - DNA, 1495 bp, Porphyrobacter sp. CCH7-A1; identical to SEQ ID NO: 1945
  ref <308>: DATABASE ACCESSION NUMBER: NCBI ACCESSION: NZ_LSJG01000178.1
  ref <309>: DATABASE ENTRY DATE: 2019-04-01
  ref <313>: RELEVANT RESIDUES IN SEQ ID NO: (1)..(1495)

SEQ ID NO: 6836 - DNA, 1491 bp, Porphyrobacter sp. HL-46
  ref <308>: DATABASE ACCESSION NUMBER: NCBI ACCESSION: NZ_JQMU01000001.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggagctcaactccggaactgcctttgaaactggagagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagttgtccgggctcatagagcttgggtgacgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6837 - DNA, 1489 bp, Porphyrobacter sp. HT-58-2
  ref <308>: DATABASE ACCESSION NUMBER: NCBI ACCESSION: NZ_CP022600.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctttttaagtcaggggtgaaatcccggggctcaacctcggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaag

SEQ ID NO: 6838 - DNA, 1491 bp, Porphyrobacter sp. LM 6
  ref <308>: DATABASE ACCESSION NUMBER: NCBI ACCESSION: NZ_CP017113.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6839 - DNA, 1489 bp, Porphyrobacter sp. TH134
  ref <308>: DATABASE ACCESSION NUMBER: NCBI ACCESSION: NZ_PKRO01000072.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagtgagaaattactgctaataccggatgatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaag

SEQ ID NO: 6840 - DNA, 1491 bp, Porphyrobacter tepidarius
  ref <308>: DATABASE ACCESSION NUMBER: NCBI ACCESSION: NZ_MUYJ01000004.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactggagagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 6841 - DNA, 1535 bp, Porphyromonas sp. 31 2
  ref <308>: DATABASE ACCESSION NUMBER: NCBI ACCESSION: NZ_KL544022.1
  ref <309>: DATABASE ENTRY DATE: 2019-04-01
  ref <313>: RELEVANT RESIDUES IN SEQ ID NO: (1)..(1535)
caatttaaacaacgaagagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctttct

SEQ ID NO: 6842 - DNA, 1467 bp, Poseidonocella pacifica
  ref <308>: DATABASE ACCESSION NUMBER: NCBI ACCESSION: NZ_FOJU01000010.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagaccttcgggtctagcggcggacgggttagtaacgcgtgggaacgtgcccttctctacggaatagtctcgggaaactgggtttaataccgtatacgcccttcgggggaaagatttatcggagaaggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactgaaaagttgggggtgaaatcccggggctcaaccccggaacggcctccaaaactagcagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgctccagagatggagttttcacttcggtgacctagtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggtgtctacagtgggttaatccccaaaagacatctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaaccttcggggggcaggcggccacggtaggatcagcgactggggtgaagtcgtaacaaggtagccgtaggggaacctgcggctggatcacctcctttctaa

SEQ ID NO: 6843 - DNA, 1553 bp, Pragia fontium
  ref <308>: DATABASE ACCESSION NUMBER: NCBI ACCESSION: NZ_LR134531.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtggctaataccgcgtaacgtcgcaagaccaaagagggggaccttcgggcctctcgccatcagatgtgcccagatgggattagctagtaggtggggtaatggctcacctaggcgacgatccctagctggtctgagaggatgaccagccacactgggactgagacacggcccagactcctacgggaggcagcagtggggaatattgcacaatgggggaaaccctgatgcagccatgccgcgtgtgtgaagaaggccttagggttgtaaagcactttcagcggggaggaagggtaggtacttaatacgtgcttacattgacgttacccgcagaagaagcaccggctaactccgtgccagcagccgcggtaatacggagggtgcaagcgttaatcggaattactgggcgtaaagcgcacgcaggcggtttgttaagttagatgtgaaatccccgggcttaacctgggaactgcatttaaaactggcaagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcgtatacaaagagaagctaactcgcgagagcatgcggacctcataaagtacgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaaga

SEQ ID NO: 6844 - DNA, 1467 bp, Primorskyibacter insulae
  ref <308>: DATABASE ACCESSION NUMBER: NCBI ACCESSION: NZ_OMOJ01000023.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggttagtaacgcgtgggaacgtacccagatctgcggaatagccactggaaacggtgagtaataccgcatacgcccttcgggggaaagatttatcggatttggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagttgggggtgaaatcccggggctcaaccccggaactgcctccaaaactcctggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatcccaaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtctacccgaagacggtgcgccaacctttcgagggggcagctggccacggtaggctcagcgactggggtgaagtcgtaacaaggtagccgtaggggaacctgcggctggatcacctcctttctaa

SEQ ID NO: 6845 - DNA, 1471 bp, Primorskyibacter marinus
  ref <308>: DATABASE ACCESSION NUMBER: NCBI ACCESSION: NZ_QJSD01000014.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcgcccttcggggtgagcggcggacgggttagtaacgcgtgggaacatacccttctctaaggaatagtctcgggaaactgagggtaataccttatacgcccttcgggggaaagatttatcggagatggattggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgaatgatgaaggtcttaggattgtaaagttctttcgctggggatgataatgacagtacccagtaaagaagtcccggctaactccgtgccagcagccgcggtaatacggaggggactagcgttgttcggaattactgggcgtaaagcgcgcgtaggcggatcagcaagttaggggtgaaatcccggggctcaaccccggaactgcccttaaaactgttggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccacatggagagatccatggttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaagctgtctcagttcggattgttctctgcaactcgagagcatgaagtcggaatcgctagtaatcgcgtaacagcatgacgcggtgaatacgttcccgggccttgtacacaccgcccgtcacaccatgggagttgggttcacccgaaggccgtgcgccaacctcttcggagggggcagcggaccacggtgagctcagcgactggggtgaagtcgtaacaaggtagccgtaggggaacctgcggctggatcacctcctttctaa

SEQ ID NO: 6846 - DNA, 1483 bp, Prochlorococcus marinus
  ref <308>: DATABASE ACCESSION NUMBER: NCBI ACCESSION: NZ_QJUF01000003.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcctttcaagtctgctgttaaagcgtggagcttaactccatcatggcagtggaaactgattggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatcctgcgaacctttaagaaattagagggtgccttcgggaacgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacgtcctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccacgcccgaagtcgttactttaacccttgtggagaaggacgccgaaggtggggctgatgactggggtgaagtcgtaacaaggtagccgtaccggaaggtgcggctggatcacctcctaa

SEQ ID NO: 6847 - DNA, 1483 bp, Prochlorococcus sp. HOT208 60m 808G21
  ref <308>: DATABASE ACCESSION NUMBER: NCBI ACCESSION: NZ_MWOY01000126.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaatgaatttcgcctgaggatgagctcgcgtctgattagctagttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctaatgactggggtgaagtcgtaacaaggtagccgtaccggaaggtgcggctggatcacctcctaa

SEQ ID NO: 6848 - DNA, 1483 bp, Prochlorococcus sp. HOT208 60m 810B23
  ref <308>: DATABASE ACCESSION NUMBER: NCBI ACCESSION: NZ_MWOW01000077.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaatgaatttcgcctgaggatgagctcgcgtctgattagctagttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccctcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctaatgactggggtgaagtcgtaacaaggtagccgtaccggaaggtgcggctggatcacctcctaa

SEQ ID NO: 6849 - DNA, 1483 bp, Prochlorococcus sp. HOT208 60m 810P02
  ref <308>: DATABASE ACCESSION NUMBER: NCBI ACCESSION: NZ_MWOV01000110.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaatgaatttcgcctgaggatgagctcgcgtctgattagctagttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggaagaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggatgccgaaggtggggctaatgactggggtgaagtcgtaacaaggtagccgtaccggaaggtgcggctggatcacctcctaa

SEQ ID NO: 6850 - DNA, 1483 bp, Prochlorococcus sp. HOT212 60m 824C06; identical to SEQ ID NO: 6847
  ref <308>: DATABASE ACCESSION NUMBER: NCBI ACCESSION: NZ_MWPF01000157.1
  ref <309>: DATABASE ENTRY DATE: 2019-04-01
  ref <313>: RELEVANT RESIDUES IN SEQ ID NO: (1)..(1483)

SEQ ID NO: 6851 - DNA, 1483 bp, Prochlorococcus sp. HOT212 60m 826P21; identical to SEQ ID NO: 6847
  ref <308>: DATABASE ACCESSION NUMBER: NCBI ACCESSION: NZ_MWPC01000016.1
  ref <309>: DATABASE ENTRY DATE: 2019-04-01
  ref <313>: RELEVANT RESIDUES IN SEQ ID NO: (1)..(1483)

SEQ ID NO: 6852 - DNA, 1483 bp, Prochlorococcus sp. MIT 0601
  ref <308>: DATABASE ACCESSION NUMBER: NCBI ACCESSION: NZ_JNAU01000004.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaacgaatttcgcctgaggatgagcccgcgtctgattagctagttggtgaggtaatggctcaccaaggcttcgatcagtagctggtctgagaggatgatcagccacactgggactgagacacggcccagactcctacgggaggcagcagtggggaattttccgcaatgggcgcaagcctgacggagcaacgccgcgtgagggatgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcctttcaagtctgctgttaaaacgtggagcttaactccatcatggcagtggaaactgatgggcttgagtatggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctttaagaaattagagggtgccttcgggaacgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacatcctgggctacacacgtactacaatgctgcggacaaagggcagcaagctcgcgagagcaagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctgatgactggggtgaagtcgtaacaaggtagccgtaccggaaggtgcggctggatcacctcctaa

SEQ ID NO: 6853 - DNA, 1483 bp, Prochlorococcus sp. MIT 0602
  ref <308>: DATABASE ACCESSION NUMBER: NCBI ACCESSION: NZ_JNAV01000002.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcccttcaagtctgctgtaaaaacgtggagcttaactccatcatcgcagtggaaactgtagggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccaggatttgacatcctgcgaacctcttagaaatttgagggtgccttcgggaacgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacatcctgggctacacacgtactacaatgctacggacaaagggcagcaaactcgcgagggcaagcaaatcccataaaccgtggctcagttcagatcgtaggctgcaactcgcctacgtgaagcaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctgatgactggggtgaagtcgtaacaaggtagccgtaccggaaggtgcggctggatcacctcctaa

SEQ ID NO: 6854 - DNA, 1285 bp, Prochlorococcus sp. MIT 0603
  ref <308>: DATABASE ACCESSION NUMBER: NCBI ACCESSION: NZ_JNAW01000001.1
  ref <309>: DATABASE ENTRY DATE: 2019-04-01
  ref <313>: RELEVANT RESIDUES IN SEQ ID NO: (1)..(1285)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcccttcaagtctgctgtaaaaacgtggagcttaactccatcatcgcagtggaaactgtagggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccaggatttgacatcctgcgaacctcttagaaatttgagggtgccttcgggaacgcagtgacaggtggtgcatggctgtcgtcagctcgtgtcgtgagatgttgggttaagtcccgcaacgagcgcaacccttgtccttagttgccagccttaagttgggcactctaaggagactgccggtgacaaaccggaggaaggtggggacgacgtcaagtcatcatggcccttacgtgtagggctacacacgtgctacaatggcatttacagagggaagcgagacagtgatgtggagcggaccccttaaagaatgtcgtagtccggattggagtctgcaactcgactccatgaagtcggaatcgct

SEQ ID NO: 6855 - DNA, 1483 bp, Prochlorococcus sp. MIT 0604
  ref <308>: DATABASE ACCESSION NUMBER: NCBI ACCESSION: NZ_CP007753.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaatgaatttcgcctgaggatgagctcgcgtctgattagctagttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgcctcttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctaatgactggggtgaagtcgtaacaaggtagccgtaccggaaggtgcggctggatcacctcctaa

SEQ ID NO: 6856 - DNA, 1483 bp, Prochlorococcus sp. MIT 0701
  ref <308>: DATABASE ACCESSION NUMBER: NCBI ACCESSION: NZ_JNBA01000052.1
  ref <309>: DATABASE ENTRY DATE: 2019-04-01
  ref <313>: RELEVANT RESIDUES IN SEQ ID NO: (1)..(1483)
tacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgaggtaatggctcaccaaggcatcgatcagtagctggtctgagaggatgatcagccacactgggactgagacacggcccagactcctacgggaggcagcagtggggaattttccgcaatgggcgcaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcttttcaagtctgctgttaaaacgtggagcttaactccatcaaggcagtggaaactgattggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctctaagaaattagagggtgcctttgggaacgcagtgacaggtggtgcatggctgtcgtcagctcgtgtcgtgagatgttgggttaagtcccgcaacgagcgcaacccacgtttttagttgccagcattcagttgggcactctagagagaccgccggtgataaaccggaggaaggtgtggatgacgtcaagtcatcatgccccttacatcctgggctacacacgtactacaatgctacggacaaagggcagcgaactcgcgagggcaagcaaatcccataaaccgtggctcagttcagatcgtaggctgcaactcgcctacgtgaagacggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtatccgtaccggaaggtgcggatggatcacctcctaa

SEQ ID NO: 6857 - DNA, 1483 bp, Prochlorococcus sp. MIT 0702; identical to SEQ ID NO: 6856
  ref <308>: DATABASE ACCESSION NUMBER: NCBI ACCESSION: NZ_JNBB01000057.1
  ref <309>: DATABASE ENTRY DATE: 2019-04-01
  ref <313>: RELEVANT RESIDUES IN SEQ ID NO: (1)..(1483)

SEQ ID NO: 6858 - DNA, 1483 bp, Prochlorococcus sp. MIT 0703; identical to SEQ ID NO: 6856
  ref <308>: DATABASE ACCESSION NUMBER: NCBI ACCESSION: NZ_JNBC01000051.1
  ref <309>: DATABASE ENTRY DATE: 2019-04-01
  ref <313>: RELEVANT RESIDUES IN SEQ ID NO: (1)..(1483)

SEQ ID NO: 6859 - DNA, 1483 bp, Prochlorococcus sp. MIT 0801
  ref <308>: DATABASE ACCESSION NUMBER: NCBI ACCESSION: NZ_CP007754.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagcttgttggtgaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcccttcaagtctgctgttaaagcgtggagcttaactccatcatggcagtggaaactgattggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatcctgcgaacctttaagaaattagagggtgccttcgggaacgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacgtcctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccacgcccgaagtcgttactttaacccttgtggagaaggacgccgaaggtggggctgatgactggggtgaagtcgtaacaaggtagccgtaccggaaggtgcggctggatcacctcctaa

SEQ ID NO: 6860 - DNA, 1483 bp, Prochlorococcus sp. MIT 1303
  ref <308>: DATABASE ACCESSION NUMBER: NCBI ACCESSION: NZ_LVHK01000009.1
  ref <309>: DATABASE ENTRY DATE: 2019-04-01
  ref <313>: RELEVANT RESIDUES IN SEQ ID NO: (1)..(1483)
acggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgtaggtaatggctcaccaaggcatcgatcagtagctggtctgagaggatgatcagccacactgggactgagacacggcccagactcctacgggaggcagcagtggggaattttccgcaatgggcgcaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcttttcaagtctgctgttaaaacgtggagcttaactccatcaaggcagtggaaactgattggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgcctttgggaacgcagtgacaggtggtgcatggctgtcgtcagctcgtgtcgtgagatgttgggttaagtcccgcaacgagcgcaacccacgtttttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaagaaggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtatccgtaccggaaggtgcggatggatcacctcctaa

SEQ ID NO: 6861 - DNA, 1482 bp, Prochlorococcus sp. MIT 1306
  ref <308>: DATABASE ACCESSION NUMBER: NCBI ACCESSION: NZ_LVHL01000003.1
  ref <309>: DATABASE ENTRY DATE: 2019-04-01
  ref <313>: RELEVANT RESIDUES IN SEQ ID NO: (1)..(1482)
acggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgaggtaatggctcaccaaggcatcgatcagtagctggtctgagaggatgatcagccacactgggactgagacacggcccagactcctacgggaggcagcagtggggaattttccgcaatgggcgcaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcaaggcagtggaaactgattggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgcctttgggaacgcagtgacaggtggtgcatggctgtcgtcagctcgtgtcgtgagatgttgggttaagtcccgcaacgagcgcaacccacgtttttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaagaaggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtatccgtaccggaaggtgcggatggatcacctcctaa

SEQ ID NO: 6862 - DNA, 1483 bp, Prochlorococcus sp. RS01; identical to SEQ ID NO: 6847
  ref <308>: DATABASE ACCESSION NUMBER: NCBI ACCESSION: NZ_CP018345.1
  ref <309>: DATABASE ENTRY DATE: 2019-04-01
  ref <313>: RELEVANT RESIDUES IN SEQ ID NO: (1)..(1483)

SEQ ID NO: 6863 - DNA, 1483 bp, Prochlorococcus sp. RS04; identical to SEQ ID NO: 6847
  ref <308>: DATABASE ACCESSION NUMBER: NCBI ACCESSION: NZ_CP018346.1
  ref <309>: DATABASE ENTRY DATE: 2019-04-01
  ref <313>: RELEVANT RESIDUES IN SEQ ID NO: (1)..(1483)

SEQ ID NO: 6864 - DNA, 1483 bp, Prochlorococcus sp. RS50; identical to SEQ ID NO: 6847
  ref <308>: DATABASE ACCESSION NUMBER: NCBI ACCESSION: NZ_CP018344.1
  ref <309>: DATABASE ENTRY DATE: 2019-04-01
  ref <313>: RELEVANT RESIDUES IN SEQ ID NO: (1)..(1483)

SEQ ID NO: 6865 - DNA, 1483 bp, Prochlorococcus sp. SS52
  ref <308>: DATABASE ACCESSION NUMBER: NCBI ACCESSION: NZ_JNBE01000008.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcctttcaagtctgctgtaaaaacgtggagcttaactccatcatcgcagtggaaactgaagggctcgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccaggatttgacatcctgcgaacctcttagaaatttgagggtgccttcgggaacgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacatcctgggctacacacgtactacaatgctacggacaaagggcagcaaactcgcgagagcaagcaaatcccataaaccgtggctcagttcagatcgtaggctgcaactcgcctacgtgaagcaggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtagccgtaccggaaggtgcggctggatcacctcctaa

SEQ ID NO: 6866 - DNA, 1493 bp, Prochlorothrix hollandica
  ref <308>: DATABASE ACCESSION NUMBER: NCBI ACCESSION: NZ_KB235938.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggcgtgcttaacacatgcaagtcgaacgaagtcttcggacttagtggcggacgggtgagtaacgcgtgaggacctaccctaaggacggggacaacagttggaaacgactgctaatacccgatgtgccgagaggtgaaagatttatcgcctaaggatggactcgcgtcagattagctagttggtgtggtaacggcataccaaggcaacgatctgtagctggtctgagaggatgatcagccacactgggactgagacacggcccagactcctacgggaggcagcagtggggaattttccgcaatgggcgaaagcctgacggagcaacgccgcgtgtgggaggaaggttttaggactgtaaaccacttttctcagggaagaagatctgacggtacctgaggaatcagcatcggctaattccgtgccagcagccgcggtaatacgggagatgcaagcgttatccggaattattgggcgtaaagcgtccgcaggcggtcttataagtctgtcgttaaagcacacagcttaactgtgggagagcgatggaaactgtgagactagagtgcggtaggggtagggggaattcccggtgtagcggtgaaatgcgtagatatcgggaagaacaccagcagcgaaagcgccctactgggccgcaactgacgctcatggacgaaagctaggggagcgaaagggattagatacccctgtagtcctagccgtaaacgatggacactaggtgttgtctgtatcgacccggacagtgccgtagctaacgcgttaagtgtcccgcctggggagtacgcacgcaagtgtgaaactcaaaggaattgacgggggcccgcacaagcggtggagtatgtggtttaattcgatgcaacgcgaagaaccttaccagggcttgacatcccgcgaatctctgtgaaagtggagagtgccttcgggagcgcggagacaggtggtgcatggctgtcgtcagctcgtgtcgtgagatgttgggttaagtcccgcaacgagcgcaaccctcgttcttagttgccatcattaagttgggcactctagggagactgccggtgacaaaccggaggaaggtggggacgacgtcaagtcatcatgccccttacgtcctgggctacacacgtactacaatgctagggacaaagagcagccaactcgcgagagtgagctaatctcataaaccctggctcagttcggattgcaggctgcaactcgcctgcatgaagtaggaatcgctagtaatcgcaggtcagaatactgcggtgaatacgttcccgggccttgtacacaccgcccgtcacaccatggaagttggccacgcccgaagtcgttaccctaaccgttcgcggaggggggcgccgaaggcagggctgatgactggggtgaagtcgtaacaaggtagccgtaccggaaggtgtggctggatcacctcctttaaggg

SEQ ID NO: 6867 - DNA, 1449 bp, Prolinoborus fasciculus
  misc_feature (1357)..(1357): n is a, c, g, or t
  ref <308>: DATABASE ACCESSION NUMBER: NCBI ACCESSION: NZ_ONZB01000239.1
  ref <309>: DATABASE ENTRY DATE: 2019-04-01
  ref <313>: RELEVANT RESIDUES IN SEQ ID NO: (1)..(1449)
acctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgnaaggaggacgcttaccacggtgtggcagatgactggggtgaagtcgtaacaaggtagccgtaggggaacctgcggctggatcacctccttaa

SEQ ID NO: 6868 - DNA, 1524 bp, Prolixibacteraceae bacterium XSD2
  ref <308>: DATABASE ACCESSION NUMBER: NCBI ACCESSION: NZ_QWGR01000031.1
  ref <309>: DATABASE ENTRY DATE: 2019-04-01
  ref <313>: RELEVANT RESIDUES IN SEQ ID NO: (1)..(1524)
tacaacggagagtttgatcctggctcaggatgaacgctagcgggaggcttaacacatgcaagtcgagcgggattcaccttcgggtgatgagagcggcgcacgggtgcgtaacgcgtatgcaacctgccttgtacagggggatagcccatggaaacgtggattaataccccatagtatcactgaaccgcatggtttaatgattaaaactgaggtggtacaagatgggcatgcgtaggattagctagtaggtgaggtaacggctcacctaggcaacgatccttaggggttctgagaggattatcccccacactggtactgagacacggaccagactcctacgggaggcagcagtgaggaatattggtcaatggacgagagtctgaaccagccatcccgcgtgcaggatgacggccctatgggttgtaaactgcttttctatgccaagaaacctgactacgtgtagtcagttgccggtagcataggaataagcatcggctaactccgtgccagcagccgcggtaatacggaggatgcaagcgttatccggattcattgggtttaaagggtgcgcaggtgggcttgtaagtcagtggtgaaatgctgccgcttaacggtagaactgccattgatactgcaagtcttgaatatggttgaggtaggcggaatgtgttgtgtagcggtgaaatgcatagatatgacacagaacgccgattgcgaaggcagcttactaagccataattgacgctgaggcacgaaagcgtggggagcgaacaggattagataccctggtagtccacgctgtaaacgatgatcactcgctgtttgcgatacacagtaagcggctgagcgaaagcattaagtgatccacctggggagtacgatcgcaaggttgaaactcaaaggaattgacgggggcccgcacaagcggaggaacatgtggtttaattcgatgatacgcgaggaaccttacctgggcttaaatgtagattgcatagattggaaacagtctttcccttcggggctatttacaaggtgctgcatggttgtcgtcagctcgtgccgtgaggtgtcgggttaagtcccataacgagcgcaacccctaccgttagttgccatcaggtcatgctggggactctagcgggactgccaccgtaaggtgagaggaaggtggggatgacgtcaaatcagcacggcccttatgtccagggctacacacgtgttacaatggtcggtacaaagggcagctacactgcgaagtgatgctaatctcaaaagccgatcccagttcggattggagtctgcaacccgactccatgaagttggattcgctagtaatcgcgcatcagccatggcgcggtgaatacgttcccgggccttgtacacaccgcccgtcaaaccatggaagctgggggtgcctgaagtctgtgaccgagaggagcggcctagggtaaaaccggtaactggggttaagtcgtaacaaggtagccgtaccggaaggtgtggctggaacacctcctttctgga

SEQ ID NO: 6869 - DNA, 1531 bp, Promicromonospora flava
tttacggagagtttgatcctggctcaggacgaacgctggcggcgtgcttaacacatgcaagtcgaacggtgaagcccagcttgctgggtggatcagtggcgaacgggtgagtaacacgtgagcaacctgccctccacttcgggataagccttggaaacggggtctaataccggatatgagcactcatcgcatggtgggtgttggaaagtttttcggtgggggatgggctcgcggcctatcagcttgttggtggggtgatggcctaccaaggcttcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccgaggctcaacctcgggcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtacgagaacacgctagagatagcggactctttggacactcgtatacaggtggtgcatggttgtcgtcagctcgtgtcgtgagatgttgggttaagtcccgcaacgagcgcaaccctcgtcctatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagctcatggcccaaccggttttccggggggagtggtcgaaggtgggactggcgattgggactaagtcgtaacaaggtagccgtaccggaaggtgcggctggatcacctcctttctaagga

SEQ ID NO: 6870 - DNA, 1523 bp, Promicromonospora sp. PT9
  ref <308>: DATABASE ACCESSION NUMBER: NCBI ACCESSION: NZ_UWYY01000052.1
  ref <309>: DATABASE ENTRY DATE: 2019-04-01
  ref <313>: RELEVANT RESIDUES IN SEQ ID NO: (1)..(1523)
tttacggagagtttgatcctggctcaggacgaacgctggtggcgtgcttaacacatgcaagtcgaacggtgaagctcagcttgctgggtggatcagtggcgaacgggtgagtaacacgtgagcaacctgccccctacttcgggataagccttggaaacggggtctaataccggatatgaacatctatcgcatggtgggtgttggaaagtttttcggtgggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccacgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtggggccagttccactggttctgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtacgagaacgccccagagatggggttctctttggacactcgtacacaggtggtgcatggttgtcgtcagctcgtgtcgtgagatgttgggttaagtcccgcaacgagcgcaacccttatcctatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcaagtcacgaaagttggtaacacccgaagctcacggcccaaccctcgggagggagtggtcgaaggtgggactggcgattgggactaagtcgtaacaaggtagccgtaccggaaggtgcggctggatcacctcctttcta

SEQ ID NO: 6871 - DNA, 1523 bp, Promicromonospora sp. YR516
  ref <308>: DATABASE ACCESSION NUMBER: NCBI ACCESSION: NZ_RCCU01000008.1
  ref <309>: DATABASE ENTRY DATE: 2019-04-01
  ref <313>: RELEVANT RESIDUES IN SEQ ID NO: (1)..(1523)
tttacggagagtttgatcctggctcaggacgaacgctggtggcgtgcttaacacatgcaagtcgaacggtgaagcccagcttgctgggtggatcagtggcgaacgggtgagtaacacgtgagcaacctgccctccacttcgggataagccttggaaacgaggtctaataccggatacgagcacttaccgcatggtgggtgttggaaagtttttcggtgggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccacgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatctcatggctcaactgtgagcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtggggccagttccactggttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtacgagaaagccccagagatggggttctctttggacactcgtacacaggtggtgcatggttgtcgtcagctcgtgtcgtgagatgttgggttaagtcccgcaacgagcgcaacccttgtctcatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcaagtcacgaaagttggtaacacccgaagctcacggcccaaccctcgggagggagtggtcgaaggtgggactggcgattgggactaagtcgtaacaaggtagccgtaccggaaggtgcggctggatcacctcctttcta

SEQ ID NO: 6872 - DNA, 1530 bp, Promicromonospora sukumoe
  ref <308>: DATABASE ACCESSION NUMBER: NCBI ACCESSION: NZ_QEKX01000001.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggtggcgtgcttaacacatgcaagtcgaacggtgaagcccagcttgctgggtggatcagtggcgaacgggtgagtaacacgtgagcaacctgccccctacttcgggataagccttggaaacgaggtctaataccggatacgagcactgaccgcatggtcggtgttggaaagtttttcggtaggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccacgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtggggcgggttccactcgttctgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtacgagaacgcgttagagataacgaactctttggacactcgtacacaggtggtgcatggttgtcgtcagctcgtgtcgtgagatgttgggttaagtcccgcaacgagcgcaacccttatcctatgttgccagcgggtcatgccggggactcatgggagactgccggggtcaactcggaggaaggtggggatgacgtcaaatcatcatgccccttatgtcttgggcttcacgcatgctacaatggccggtacagagggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcaagtcacgaaagttggtaacacccgaagctcacggcccaacccgcaagggagggagtggtcgaaggtgggactggcgattgggactaagtcgtaacaaggtagccgtaccggaaggtgcggctggatcacctcctttctaaggag

SEQ ID NO: 6873 - DNA, 1533 bp, Promicromonospora thailandica
  ref <308>: DATABASE ACCESSION NUMBER: NCBI ACCESSION: NZ_QXCY01000001.1
  ref <309>: DATABASE ENTRY DATE: 2019-04-01
  ref <313>: RELEVANT RESIDUES IN SEQ ID NO: (1)..(1533)
tttacggagagtttgatcctggctcaggacgaacgctggcggcgtgcttaacacatgcaagtcgaacggtgaagccctagcttgctggggtggatcagtggcgaacgggtgagtaacacgtgagcaacctgccccctacttcgggataagccttggaaacggggtctaataccggatatgagcactcatcgcatggtgggtgttggaaagtttttcggtgggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtggggccagttccactggttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtacgagaaagccccagagatggggttctctttggacactcgtacacaggtggtgcatggttgtcgtcagctcgtgtcgtgagatgttgggttaagtcccgcaacgagcgcaacccttgtctcatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcaagtcacgaaagttggtaacacccgaagctcacggcccaaccccttgtgggagggagtggtcgaaggtgggactggcgattgggactaagtcgtaacaaggtagccgtaccggaaggtgcggctggatcacctcctttctaaggag

SEQ ID NO: 6874 - DNA, 1524 bp, Promicromonosporaceae bacterium CFH 30434
  ref <308>: DATABASE ACCESSION NUMBER: NCBI ACCESSION: NZ_QXTH01000029.1
  ref <309>: DATABASE ENTRY DATE: 2019-04-01
  ref <313>: RELEVANT RESIDUES IN SEQ ID NO: (1)..(1524)
tttacggagagtttgatcctggctcaggacgaacgctggcggcgtgcttaacacatgcaagtcgaacggtgaagcccttcggggtggatcagtggcgaacgggtgagtaacacgtgagcaacctgccccccacttcgggataagccttggaaacgaggtctaataccggatacgacgcctgaccgcatggtcgggtgtggaaagtttttcggtgggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggacgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaaacccgaggctcaacctcgggcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggacagttccactgtttctgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggaaacacccagagatgggtgccccgcaaggtcggtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtgaggtggagcgaatccctaaaagccggtctcagttcggatcggggtctgcaactcgaccccgtgaagtcggagtcgctagtaatcgcagatcagcaacgctgcggtgaatacgttcccgggccttgtacacaccgcccgtcaagtcacgaaagttggtaacacccgaagcccatggcccaacccgcaagggggggagtggtcgaaggtgggactggcgattgggactaagtcgtaacaaggtagccgtaccggaaggtgcggctggatcacctcctttctaaggag

SEQ ID NO: 6875 - DNA, 1525 bp, Propionibacteriaceae bacterium VG341
  ref <308>: DATABASE ACCESSION NUMBER: NCBI ACCESSION: NZ_PPCV01000015.1
  ref <309>: DATABASE ENTRY DATE: 2019-04-01
  ref <313>: RELEVANT RESIDUES IN SEQ ID NO: (1)..(1525)
tcaatggagagtttgatcctggctcaggacgaacgctggcggcgtgcttaacacatgcaagtcgaacgatgatctgctcttcggagtggtgattagtggcgaacgggtgagtaacacgtgagtaacctgccctccactttgggataactgtgggaaacttcagctaataccggatattgaatactgctcgcatgggtggtgtttgaaagattttttggtgggggatggactcgcggcctatcagcttgttggtggggtaatggcctaccaaggcgatgacgggtagccggcctgagagggcgaccggccacactgggactgagatacggcccagactcctacgggaggcagcagtggggaatattgcacaatgggcgaaagcctgatgcagcaacgccgcgtgcgggatgacggccttcgggttgtaaaccgctttcaccaggggcgaatttgacggtacctggagaagaagcaccggctaactacgtgccagcagccgcggtgatacgtagggtgcgagcgttgtccggatttattgggcgtaaagagctcgtaggtggtttgttgcgtcggaagtgaaaacacagggcttaactctgtgcttgctttcgatacgggcagacttgaggaaggtaggggagaacggaattcctggtggagcggtggaatgcgcagatatcaggaggaacaccagtggcgaaggcggttctctggacctttcctgacgctgaggagcgaaagcgtggggagcaaacaggcttagataccctggtagtccacgccgtaaacggtgggcactaggtgtgggggacattccacgttctccgtgccgtagctaacgcattaagtgccccgcctggggagtacggccgcaaggctaaaactcaaaggaattgacgggggcccgcacaagcggcggagcatgcggattaattcgatgcaacgcgaagaaccttacctgggtttgacatctgccggaagcatccagagatgggtgtgcctttttggtcggttgacaggtggtgcatggctgtcgtcagctcgtgtcgtgagatgttgggttaagtcccgcaacgagcgcaaccctcgtcctatgttgccagcgggtaatgccgggaactcatgggagactgccggggtcaactcggaggaaggtggggatgacgtcaagtcatcatgccccttatgtccagggcttcacgcatgctacaatggctggtacaaagtgttgctatcccgtgagggtgcgcgaatcacgtaaagccagtctcagttcggattggggtctgcaactcgaccccatgaagtcggagtcgctagtaatcgcagatcagcattgctgcggtgaatacgttcccgggccttgtacacaccgcccgtcaagtcatgaaagtcggtaacacccgaagccggtggcctaacccttgtggggggagccgtcgaaggtgggatcggtaattaggactaagtcgtaacaaggtagccgtaccggaaggtgcggctggatcacctcctttctagggag

SEQ ID NO: 6876 - DNA, 1528 bp, Propionibacterium acidifaciens
  ref <308>: DATABASE ACCESSION NUMBER: NCBI ACCESSION: NZ_CP033719.1
  ref <309>: DATABASE ENTRY DATE: 2019-04-01
  ref <313>: RELEVANT RESIDUES IN SEQ ID NO: (1)..(1528)
ttttacggagagtttgatcctggctcaggacgaacgctggcggcgtgcttaacacatgcaagtcgaacggtaaggcgctttcgggcgtacacgagtggcgaacgggtgagtaacacgtgaggaacgtgcccttgactttggtatagcacttggaaacaggtggtaatcccgaatattcagtttcccgggcatccgggttgttggaaagctttttgcggtcagggatcgtctcgcggcctatcagcttgttggtggggtagtggcccaccaaggccttgacgggtagccggcctgagagggcgaccggccacattgggactgagatacggcccagactcctgcgggaggcagcagtggggaatattgcacaatgggcggaagcctgatgcagcaacgccgcgtgcgggatgacggccttcgggttgtaaaccgctttcacccatgacgaagcgcgagtgacggtagtgggggaagaagcaccggccaactacgtgccagcagccgcggtgatacgtagggtgcgagcgttgtccggaattattgggcgtaaagagcttgtaggcggttgatcgcgtcgatagtgaaatcccggggctcaacctcgggcttgctgtcgatacgggttgacttgaggaaggtaggggagaatggaactcccggtggagcggtggaatgcgcagatatcgggaagaacaccggtggcgaaggcggttctctggacctttcctgacgctgagaagcgaaagcgtggggagcaaacaggcttagataccctggtagtccacgctgtaaacggtgggtactaggtgtgggtcgcattccacgtgatccgtgccgtagccaacgcattaagtaccccgcctggggagtacggccgcaaggctaaaactcaaaggaattgacggggccccgcacaagcggcggagcatgcggattaattcgatgcaacgcgaagaaccttacctgggtttgacatgtactggaagcgctcagagatgggcgtgccttttcggccggttcacaggtggtgcatggctgtcgtcagctcgtgtcgtgagatgttgggttaagtcccgcaacgagcgcaaccctcgtccaatgttgccagcagttcggctggggactcgttggagaccgccggggtcaactcggaggaaggtggggatgaggtcaagtcatcatgcccctcatgtccagggcttcacgcatgctacaatggccggtacaaagagttgcgagcctgtgagggtgagcgaatctcggaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctgtcccttgtggggggagccgtcgaaggtgggactggtgattaggactaagtcgtaacaaggtagccgtaccggaaggtgcggctggatcacctcctttctaagga

SEQ ID NO: 6877 - DNA, 1531 bp, Propionibacterium australiense
  ref <308>: DATABASE ACCESSION NUMBER: NCBI ACCESSION: NZ_LR134442.1
  ref <309>: DATABASE ENTRY DATE: 2019-04-01
  ref <313>: RELEVANT RESIDUES IN SEQ ID NO: (1)..(1531)
ttttcgacggagagtttgatcctggctcaggacgaacgctggcggcgtgcttaacacatgcaagtcgaacggtaaggcgccttttggtgtacacgagtggcgaacgggtgagtaacacgtgaggaacgtgcccttgactttggtatagcacttggaaacaggtggtaatcccgaatattcagtttcccgggcatctggggggttggaaagcttttgcggtcagggatcgtctcgcggcctatcagcttgttggtggggtagtggcctaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcacccatgacgaagcttttgtgacggtagtgggggaagaagcaccggccaactacgtgccagcagccgcggtgatacgtagggtgcgagcgttgtccggaattattgggcgtaaagagcttgtaggcggttgatcgcgtcgatagtgaaatcccggggcttaacttcgggcttgctttcgatacgggttgacttgaggaaggtaggggagaatggaattcccggtggagcggtggaatgcgcagatatcgggaggaacaccggtggcgaaggcggttctctggacctttcctgacgctgagaagcgaaagcgtggggagcaaacaggcttagataccctggtagtccacgctgtaaacggtgggtactaggtgtgggtcacattccacgtggtccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtgccggaagcattcagagatgggtgtgcctttttggccggttcacaggtggtgcatggctgtcgtcagctcgtgtcgtgagatgttgggttaagtcccgcaacgagcgcaaccctcgtccaatgttgccagcagttcggctggggactcattggagaccgccggggtcaactcggaggaaggtggggatgaggtcaagtcatcatgccccttatgtccagggcttcacgcatgctacaatggccggtacaaagagttgcgagcctgtgagggtgagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctgtccttttttgggggggagccgtcgaaggtgggactggtgattaggactaagtcgtaacaaggtagccgtaccggaaggtgcggctggatcacctcctttctaagga

SEQ ID NO: 6878 - DNA, 1533 bp, Propionibacterium cyclohexanicum
  ref <308>: DATABASE ACCESSION NUMBER: NCBI ACCESSION: NZ_FOGZ01000044.1
  ref <309>: DATABASE ENTRY DATE: 2019-04-01
  ref <313>: RELEVANT RESIDUES IN SEQ ID NO: (1)..(1533)
ggtttttcaacggagagtttgatcctggctcaggacgaacgctggcggcgtgcttaacacatgcaagtcgaacggtaaggcaccttcgggtgtacacgagtggcgaacgggtgagtaacacgtgaggaacgtacccttcacttcggtatagcatctggaaacaggtggtaatcccggatatgagctgggcgggcatccgtctggttggaaagccttgtgcggtgggggatcgtctcgcggcctatcagcttgttggtggggtagtggcctaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcacccatgacgaagcgtgagtgacggtagtgggagaagaagcaccggccaactacgtgccagcagccgcggtgatacgtagggtgcgagcgttgtccggaattattgggcgtaaagagcttgtaggcggttgatcgcgtcgaaagtgaaattccagggcttaactctgggcttgctttcgatacgggtcgacttgaggaaggtaggggagaatggaattcccggtggagcggtggaatgcgcagatatcgggaggaacaccagtggcgaaggcggttctctggacctttcctgacgctgagaagcgaaagcgtggggagcaaacaggcttagataccctggtagtccacgccgtaaacggtgggtactaggtgtgggtctcattccacgagatccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtgccggaagtattcagagatgggtgcgcctttttggtcggtacacaggtggtgcatggctgtcgtcagctcgtgtcgtgagatgttgggttaagtcccgcaacgagcgcaaccctcgtccaatgttgccagcagttcggctggggactcattggagactgccggggacaactcggaggaaggtggggatgaggtcaagtcatcatgccccttatgtccagggcttcacgcatgctacaatggctggtacaaagagctgcgagcctgtgagggtgagcgaatctcagaaagccagtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctatcccttgtggggggagccgtcgaaggtgggactggtgattaggactaagtcgtaacaaggtagccgtaccggaaggtgcggctggatcacctcctttctaaggag

SEQ ID NO: 6879 - DNA, 1530 bp, Propionibacterium freudenreichii
  ref <308>: DATABASE ACCESSION NUMBER: NCBI ACCESSION: NZ_OVTV01000269.1
  ref <309>: DATABASE ENTRY DATE: 2019-04-01
  ref <313>: RELEVANT RESIDUES IN SEQ ID NO: (1)..(1530)
ttttcaacggagagtttgatcctggctcaggacgaacgctggcggcgtgcttaacacatgcaagtcggacggtaaggcccctttcggggggtacacgagtggcgaacgggtgagtaacacgtgaggaacgtgcccttgacttcggtatagctccaggaaactggtggtaatcccgaatatgagcctggcctgcatgggttgggttggaaagctttatgcggtcagggatcgtctcgcggcctatcagcttgttggtggggtaatggcctaccaaggcagcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcatccatgacgaagcgcaagtgacggtagtgggagaagaagcaccggctaactacgtgccagcagccgcggtgatacgtagggtgcgagcgttgtccggaattattgggcgtaaagagcttgtaggcggttgatcacgtcggaagtgaaattccagggcttaactctgggcttgctttcgatacgggttgacttgaggaatgtaggggagaatggaactctcggtggagcggtggaatgcgcagatatcgggaagaacaccagtggcgaaggcggttctctggacatttcctgacgctgagaagcgaaagcgtggggagcaaacaggcttagataccctggtagtccacgccgtaaacggtgggtactaggtgtgggtcccttccacggggtccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtactggaagcgttcagagatgggcgtgcctttttggctggtacacaggtggtgcatggctgtcgtcagctcgtgtcgtgagatgttgggttaagtcccgcaacgagcgcaaccctcgtccaatgttgccagcagttcggctggggactcattggagaccgccggggccaactcggaggaaggtggggatgaggtcaagtcatcatgccccttatgtccagggcttcacgcatgctacaatggccggtacaaagagttgcgagcctgtgagggtgagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttggggggagccgtcgaaggtgggactggtgattaggactaagtcgtaacaaggtagccgtaccggaaggtgcggctggatcacctcctttctaaggag

SEQ ID NO: 6880 - DNA, 1449 bp, Propionibacterium sp. JV5
  ref <308>: DATABASE ACCESSION NUMBER: NCBI ACCESSION: NZ_OMOH01000021.1
  ref <309>: DATABASE ENTRY DATE: 2019-04-01
  ref <313>: RELEVANT RESIDUES IN SEQ ID NO: (1)..(1449)
ttttggtgtacacgagtggcgaacgggtgagtaacacgtgaggaacgtgcccttgactttggtatagcacttggaaacaggtggtaatcccgaatattcagtttcccgggcatccgggttgttggaaagcttttgcggtcagggatcgtctcgcggcctatcagcttgttggtggggtagtggcctaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcacccatgacgaagcttttgtgacggtagtgggggaagaagcaccggccaactacgtgccagcagccgcggtgatacgtagggtgcgagcgttgtccggaattattgggcgtaaagagcttgtaggcggttgattgcgtcgatagtgaaatcccggggcttaacttcgggcttgctgtcgatacgggttgacttgaggaaggtaggggagaatggaattcccggtggagcggtggaatgcgcagatatcgggaggaacaccagtggcgaaggcggttctctggacctttcctgacgctgagaagcgaaagcgtggggagcaaacaggcttagataccctggtagtccacgctgtaaacggtgggtactaggtgtgggtcacattccacgtggtccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtgccggaagcattcagagatgggtgtgcctttttggccggttcacaggtggtgcatggctgtcgtcagctcgtgtcgtgagatgttgggttaagtcccgcaacgagcgcaaccctcgtccaatgttgccagcagttcggctggggactcattggagaccgccggggtcaactcggaggaaggtggggatgaggtcaagtcatcatgccccttatgtccagggcttcacgcatgctacaatggccggtacaaagagttgcgagcctgtgagggtgagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctgtccatttttggggggagccgtcgaaggtgggactggtgattaggactaagtcgtaacaaggtagccgtaccggaaggtgcggctggatcacctcctttctaagga

SEQ ID NO: 6881 - DNA, 1536 bp, Propionibacterium sp. KPL2009
  ref <308>: DATABASE ACCESSION NUMBER: NCBI ACCESSION: NZ_QUMJ01000001.1
  ref <309>: DATABASE ENTRY DATE: 2019-04-01
  ref <313>: RELEVANT RESIDUES IN SEQ ID NO: (1)..(1536)
ttttcattggagagtttgatcctggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaaggag

SEQ ID NO: 6882 - DNA, 1536 bp, Propionibacterium sp. Marseille-P5998
  ref <308>: DATABASE ACCESSION NUMBER: NCBI ACCESSION: NZ_UWOQ01000009.1
  ref <309>: DATABASE ENTRY DATE: 2019-04-01
  ref <313>: RELEVANT RESIDUES IN SEQ ID NO: (1)..(1536)
tttttattggagagtttgatcctggctcaggacgaacgctggcggcgtgcttaacacatgcaagtcgaacggaaaggcctctttcggggggtactcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggtggaagcctgatgcagcaacgccgtgtgcgggatgacggccttcgggttgtaaaccgctttcgctcatgacgaagctttgtgtgacggtagtgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgcttttgatacgggttgacttgaggaaggtaggggagaatggaattcctggtggagcggtggaatgcgcagatatcaggaggaacaccggtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgaagaaccttacctgggtttgacatggatcaggagtgcttagagatgggtgcgcctcttttggggctggttcacaggtggtgcatggctgtcgtcagctcgtgtcgtgagatgttgggttaagtcccgcaacgagcgcaacccttgttcactgttgccagcacgttatggtggggactcagtggagactgccggggtcaactcggaggaaggtggggatgacgtcaagtcatcatgccccttatgtccagggcttcacgcatgctacaatggctggtacaaagagttgcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaacctgttgtgggggagccgtcgaaggtgggactggtgattaggactaagtcgtaacaaggtagccgtaccggaaggtgcggctggatcacctcctttctaaggag

SEQ ID NO: 6883 - DNA, 1536 bp, Propionibacterium sp. oral taxon 193; identical to SEQ ID NO: 6882
  ref <308>: DATABASE ACCESSION NUMBER: NCBI ACCESSION: NZ_CP017040.1
  ref <309>: DATABASE ENTRY DATE: 2019-04-01
  ref <313>: RELEVANT RESIDUES IN SEQ ID NO: (1)..(1536)

SEQ ID NO: 6884 - DNA, 312 bp, Propionispira arboris
  ref <308>: DATABASE ACCESSION NUMBER: NCBI ACCESSION: NZ_FNZK01000005.1
  ref <309>: DATABASE ENTRY DATE: 2019-04-01
  ref <313>: RELEVANT RESIDUES IN SEQ ID NO: (1)..(312)
tgggataaacagagggaagcgagaccgcgaggtggagcgaaacccataaattatctctcagttcggattgcaggctgcaactcgcctgcatgaagtcggaatcgctagtaatcgcaggtcagcatactgcggtgaatacgttcccgggtcttgtacacaccgcccgtcacaccacgaaagtcattcacacccgaagccggtggggtaaccgcaaggagccagccgtctaaggtgggggcgatgattggggtgaagtcgtaacaaggtagccgtatcggaaggtgcggctggatcacctcctttctaaggaga

SEQ ID NO: 6885 - DNA, 428 bp, Propionispira raffinosivorans
  ref <308>: DATABASE ACCESSION NUMBER: NCBI ACCESSION: NZ_KB905867.1
  ref <309>: DATABASE ENTRY DATE: 2019-04-01
  ref <313>: RELEVANT RESIDUES IN SEQ ID NO: (1)..(428)
tttattggagagtttgatcctggctcaggacgaacgctggcggcgtgcttaacacatgcaagtcgaacggaactaagcttaacaccgaatcttttaaaagtagagatgttaagccggaatgcgagtggatgaagaatgaattcaccacgcattttaaaagtgcaacacatccagtcagaagattgggtgttgagcttagtttagtggcgaacgggtgagtaacgcgtagacaacctaccttttagatggggacaacatcgcgaaagcggtgctaataccgaatgttgtgtctttcccacatgggaaagctactaaagatggcctctatatataagctgtcactaaaagatgggtctgcgtctgattagctagttggcggggtaaatgcccaccaaggcaacgatcagtagccggtctgagaggatgaa

SEQ ID NO: 6886 - DNA, 1568 bp, Propionispora sp. 2 2-37
  ref <308>: DATABASE ACCESSION NUMBER: NCBI ACCESSION: NZ_CYSP01000034.1
  ref <309>: DATABASE ENTRY DATE: 2019-04-01
  ref <313>: RELEVANT RESIDUES IN SEQ ID NO: (1)..(1568)
tttatggagagtttgatcctggctcaggacgaacgctggcggcgtgcctaacacatgcaagtcgaacggagatattcagcaatggagatcttagtggcgaacgggtgagtaacgcgtaaacaacctgcctcatagctggggacaacaccgcgaaagtggtgctaataccgaatgagatgtatcttccgcatgggaggaacaagaaaggtggcctcttaacaatgctaccgctaagagaggggtttgcgtctgattagctggttggtggggtaagggcctaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgtcttcaagggagaacgtgagcagtgtgaaaaatgctgcttaatgacggtacttgaggaggaagccacggctaactacgtgccagcagccgcggtaatacgtaggtggcgagcgttgtccggaattattgggcgtaaagggcgcgtaggcggatggttaagtccaacctaaaagtgcggggctcaaccccgtgaggggttggaaactaaccatcttgagtgcaggagaggaaagtggaattcccagtgtagcggtgaaatgcgtagatattgggaggaacaccagtggcgaaggcgactttctggactgtgtctgacgctgaggcgcgaaagccaggggagtgaacgggattagataccccggtaatcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacattgagtgaaagggctagagatagcccggtctccttctggagacacgaaaacaggtggtgcatggctgtcgtcagctcgtgtcgtgagatgttgggttaagtcccgcaacgagcgcaacccctgtcctatgttgccagcacgtaaaggtgggaactcataggagactgccgcagagaatgcggaggaaggcggggatgacgtcaagtcatcatgccccatatgtcctgggctacacacgtactacaatgggcttaaatagagggaagcgaggccgcgaggcggagcgaaccccagaaacaagctctcagttcggatcgcaggctgcaactcgcctgcgtgaagtcggaatcgctagtaatcgcagatcagcatgctgcggtgaatacgttcccgggccttgtacacaccgcccgtcacaccacgagagttggaaacacccgaagccggtggggtaacctgaaaaggaactagccgtcgaaggtggggccgatgattggggtgaagtcgtaacaaggtagccgtatcggaaggtgcggctggatcacctcctttctaaggaga

SEQ ID NO: 6887 - DNA, 1506 bp, Prosthecochloris aestuarii
  ref <308>: DATABASE ACCESSION NUMBER: NCBI ACCESSION: NC_011059.1
  ref <309>: DATABASE ENTRY DATE: 2019-04-01
  ref <313>: RELEVANT RESIDUES IN SEQ ID NO: (1)..(1506)
ttacaacggagagtttgatcctggctcaggacgaacgctggcggcgtgcctaacacatgcaagtcaaaggaaagtgacttcggttacaagtacttggcgcaagggtgagtaaggtataggtaatttgcctacaggaccgggataaccccgagaaatcggggacaataccggatgatgcagcggaaccgcatggttatgttgttaaatcaggaatggcctgtagataagcctatattccatcaggtagttggcagggtaacagcctaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgtagaggaagaatagcctgctttgcgggtgtgacggtactctacgaataagccacggctaactctgtgccagcagccgcggtgatacaggggtggcaagcgttgtccggatttactgggtgtaaagggtgcgcaggcggaatagtaagtcgggggttaaatccatgtgctcaacacatgcacggcttccgatactgctaatctagagtgtcgaagaggaaggtggaatttccggtgtaacggtggaatgtgtagatatcggaaagaacaccagtggcgaaggcagccttctggtcgacaactgacgctcaggcacgaaagcgtggggagcaaacaggattagataccctggtagtccacgccgtaaacgatgaatactagatgttggtcattcgtgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctaggcttgacatgctgactaaagctcctgaaagggagtgtccttcggggagtcagcacaggtgctgcatggctgtcgtcagctcgtgtcgtgagatgttgggttaagtcccgcaacgagcgcaacccctacaattagttgctagcaggtaaagctgaggactctaattgaactgcctacgcaagtagtgaggaaggaggggatgacgtcaagtcctcatggcccttacgcctagggccacacacgtgatacaatggcgactacagagggcaaagccgcgaggtggagataatcccttaaaagtcgtcctagtccggatcggagtctgcaactcgactccgtgaagctggaatcgctagtaatcgcagatcagcatgctgcggtgaatgtgttcccgggccttgtacacaccgcccgtcaagtcatggaagtcaggagtacccgaagacgcgtatgcgtttaaggtaagactggtaactgggactaagtcgtaacaaggtagccgtaccggaaggtgcggctggatcacctcctttta

SEQ ID NO: 6888 - DNA, 1508 bp, Prosthecochloris sp. CIB 2401
  ref <308>: DATABASE ACCESSION NUMBER: NCBI ACCESSION: NZ_CP016432.1
  ref <309>: DATABASE ENTRY DATE: 2019-04-01
  ref <313>: RELEVANT RESIDUES IN SEQ ID NO: (1)..(1508)
tacaacggagagtttgatcctggctcaggacgaacgctggcggcgtgcctaacacatgcaagtcaaaggaaagcaccttcgggtgcgagtacttggcgcaagggtgagtaaggtataggtaatttgcctacaggaccggcataaccccgagaaatcggggacaataccggatgatgcagcggaaccgcatggttatgttgttaaatcaggaatggcctgtagataagcctatattccatcaggtagttggcggggtaacggcccaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagtccttcgggatgtaaagtccttttgcagaggaagaacatgctggtttaccggcagtgacggtactctgcgaataagccacggctaactctgtgccagcagccgcggtgatacaggggtggcaagcgttgtccggatttactgggtgtaaagggtgcgcaggcggaataataagtcgggggttaaatccatgtgcttaacacatgacatgcttccgatactgttattctagagtgtcgaagaggaagatggaatttccggtgtaacggtggaatgtgtagatatcggaaagaacaccagtggcgaaggcagtcttctggtcgacaactgacgctcaggcacgaaagcgtggggagcgaacaggattagataccctggtagtccacgccgtaaacgatgaatactagatgttggtcattcgtgatcagtgtcgaagctaacgcgttaagtattccacctgggaagtacgctcgcaagagtgaaactcaaaggaattgacgggggcccacacaagcggtggatcatgtggtttaattcgatgcaacgcgaagaaccttacccgggcttgaaaggctggctaaacctcctgaaagggagggtccttcggggagccagtacaggtgctgcatggctgtcgtcagctcgtgtcgtgagatgttgggttaagtcccgcaacgagcgcaacccctacaattagttgctagcaggtaaagctgaggactctaattgaactgcctacgcaagtagagaggaaggaggggatgacgtcaagtcctcatggcccttacgtccggggctacacacgtgatacaatggtaactacagagggcaaagccgcgaggcagaggaaatcccttaaaagttatcctagtccggatcggagtctgcaactcgactccgtgaagctggaatcgctagtaatcgcagatcagcatgctgcggtgaatgtgttcctgggccttgtacacaccgcccgtcaagtcatggaagttgggagtacccgaagacgcgtatgcgtttaaggtaagaccagtaactgggactaagtcgtaacaaggtagccgtaccggaaggtgcggctggatcacctccttttaat

SEQ ID NO: 6889 - DNA, 1505 bp, Prosthecochloris sp. HL-130-GSB
  ref <308>: DATABASE ACCESSION NUMBER: NCBI ACCESSION: NZ_CP020873.1
  ref <309>: DATABASE ENTRY DATE: 2019-04-01
  ref <313>: RELEVANT RESIDUES IN SEQ ID NO: (1)..(1505)
tacaacggagagtttgatcctggctcaggacgaacgctggcggcgtgcctaacacatgcaagtcaaaggaaaacaccttcgggtgcaagtacttggcgcaagggtgagtaaggtataggtaatttgcctacaggaccggcataaccccgagaaatcggggacaataccggatgatgcagcggaaccgcatggttatgttgttaaatcaggaatggcctgtagataagcctatattccatcaggtagttggcggggtaaaagcccaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagtccttcgggatgtaaagtccttttgcagaggaagaacggcctgctttgcgggtgtgacggtactctgcgaataagccacggctaactctgtgccagcagccgcggtgatacaggggtggcaagcgttgtccggatttactgggtgtaaagggtgcgcaggcggaatagtaagtcgggggttaaatccatgtgctcaacacatgatctgcttccgatactgctaatctagagtgtcgaagaggaagatggaatttccggtgtaacggtggaatgtgtagatatcggaaagaacaccagtggcgaaggcagtcttctggtcgacaactgacgctcaggcacgaaagcgtggggagcgaacaggattagataccctggtagtccacgccgtaaacgatgaatactagatgttggtcattcgtgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctgggcttgacatgctagctaaactctctgaaaagagaggtccttcggggagctagcacaggtgctgcatggctgtcgtcagctcgtgtcgtgagatgttgggttaagtcccgcaacgagcgcaacccctacaattagttgctagcaggtaatgctgaggactctaattgaactgcctacgcaagtagtgaggaaggaggggatgacgtcaagtcctcatggcccttacgtccagggctacacacgtgatacaatggtaactacagagggcaaagccgcaaggtagaggaaatcccttaaaagttatcctagtccggatcggagtctgcaactcgactccgtgaagctggaatcgctagtaatcgcagatcagcatgctgcggtgaatgtgttcccgggccttgtacacaccgcccgtcaagtcatggaagtcaggagtacccgaagacgcgtatgcgtttaaggtaagactggtaactgggactaagtcgtaacaaggtagccgtaccggaaggtgcggctggatcacctcctttta

SEQ ID NO: 6890 - DNA, 1505 bp, Prosthecochloris sp. V1
  ref <308>: DATABASE ACCESSION NUMBER: NCBI ACCESSION: NZ_PDNZ01000010.1
  ref <309>: DATABASE ENTRY DATE: 2019-04-01
  ref <313>: RELEVANT RESIDUES IN SEQ ID NO: (1)..(1505)
acaacggagagtttgatcctggctcaggacgaacgctggcggcgtgcctaacacatgcaagtcaaaggaaaacagcttcggctgcaagtacttggcgcaagggtgagtaaggtataggtaatttgcctacaggaccggcataaccccgagaaatcggggacaataccggatgatgcagcggaaccgcatggttatgttgttaaatcaggaatggcctgtagataagcctatattccatcaggtagttggtagggtaagagcctaccaagccaacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgcagaagaagaaaatcccggcttgccgggactgacggtactctgcgaataagccacggctaactctgtgccagcagccgcggtgatacaggggtggcaagcgttgtccggatttactgggtgtaaagggtgcgcaggcggaataataagtcgggggttaaatccatgtgctcaacacatgacgtgcttccgatactgttattctagagtgtcgaagaggaagatggaatttccggtgtaacggtggaatgtgtagatatcggaaagaacaccagtggcgaaggcagtcttctggtcgacaactgacgctcaggcacgaaagcgtggggagcgaacaggattagataccctggtagtccacgccgtaaacgatgaatactagatgttggtcatacgtgatcagtgtcgcagctaacgcattaagtattccacctgggaagtacgctcgcaagagtgaaactcaaaggaattgacgggggcccgcacaagcggtggatcatgtggtttaattcgatgcaacgcgaagaaccttacctgggcttgaaaggctagttaaagctcctgaaagggagtgtccttcggggaactagtacaggtgctgcatggctgtcgtcagctcgtgtcgtgagatgttgggttaagtcccgcaacgagcgcaacccctacaattagttgctagcaggtaaagctgaggactctaattgaactgcctacgcaagtagagaggaaggaggggatgacgtcaagtcctcatggcccttacgtccagggctacacacgtgatacaatggcgactacaaagggcaaagccgcgaggtggaggaaatcccttaaaagtcgtcctagtccggatcggagtctgcaactcgactccgtgaagctggaatcgctagtaatcgtagatcagcatgctacggtgaatatgttcccgggccttgtacacaccgcccgtcaagtcatggaagtcgggagtacccgaagacgcgtctgcgtttaaggtaagaccggtaactgggactaagtcgtaacaaggtagccgtaccggaaggtgcggctggatcacctcctttta

SEQ ID NO: 6891 - DNA, 1503 bp, Prosthecochloris sp. ZM 2
  ref <308>: DATABASE ACCESSION NUMBER: NCBI ACCESSION: NZ_PDNY02000071.1
  ref <309>: DATABASE ENTRY DATE: 2019-04-01
  ref <313>: RELEVANT RESIDUES IN SEQ ID NO: (1)..(1503)
acaacggagagtttgatcctggctcaggacgaacgctggcggcgtgcctaacacatgcaagtcaaaggaaaacaccttcgggtgcaagtacttggcgcaagggtgagtaaggtataggtaatttgcctacaggaccggcataaccccgagaaatcggggacaataccggatgatgcagcggaaccgcatggttatgttgttaaatcaggaatggcctgtagataagcctatattccatcaggtagttggcggggtaacagcccaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagtccttcgggatgtaaagtccttttgcagaggaagaacagcctgctttgcgggtgtgacggtactctgcgaataagccacggctaactctgtgccagcagccgcggtgatacaggggtggcaagcgttgtccggatttactgggtgtaaagggtgcgcaggcggaatagtaagtcgggggttaaatccatgtgcttaacacatgatctgcttccgatactgctaatctagagtgtcgaagaggaagatggaatttccggtgtaacggtggaatgtgtagatatcggaaagaacaccagtggcgaaggcagtcttctggtcgacaactgacgctcaggcacgaaagcgtggggagcgaacaggattagataccctggtagtccacgccgtaaacgatgaatactagatgttggtcattcgtgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctgggcttgacatgctggttaaaactcctgaaagggagtgtccttcgggggccagcacaggtgctgcatggctgtcgtcagctcgtgtcgtgagatgttgggttaagtcccgcaacgagcgcaacccctacaattagttgctagcaggtaatgctgaggactctaattgaactgcctacgcaagtagtgaggaaggaggggatgacgtcaagtcctcatggcccttacgtccagggctacacacgtgatacaatggtgactacagagggcaaagccgcgaggcagagaaaatcccttaaaggtcatcctagtccggatcggagtctgcaactcgactccgtgaagctggaatcgctagtaatcgcagatcagcatgctgcggtgaatgtgttcccgggccttgtacacaccgcccgtcaagtcatggaagtcgggagtacccgaagacgcgtatgcgtttaaggtaagaccggtaactgggactaagtcgtaacaaggtagccgtaccggaaggtgcggctggatcacctcctttta

SEQ ID NO: 6892 - DNA, 1530 bp, Proteiniclasticum ruminis
  ref <308>: DATABASE ACCESSION NUMBER: NCBI ACCESSION: NZ_FOVK01000036.1
  ref <309>: DATABASE ENTRY DATE: 2019-04-01
  ref <313>: RELEVANT RESIDUES IN SEQ ID NO: (1)..(1530)
ttttaaattgagagtttgatcctggctcaggacgaacgctggcggcgtgcctaacacatgcaagtcgagcggagaatgcggatatgtttacatagaagcgttcttagcggcggacgggtgagtaacacgtgggtaacctgcctcaaagtgggggatagccttccgaaaggaagattaataccgcataagcctacagtgccgcatggcaccgtaggaaaaggagcaatccgctttgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggtcgtaaagctctttgatcagggatgataatgacagtacctgaaaaacaagccacggctaactacgtgccagcagccgcggtaatacgtaggtggcgagcgttgtccggaattactgggcgtaaaggatgcgtaggtggatacttaagtgggatgtgaaatccccgggctcaacccgggaactgcattccaaactgggtatctagagtgcaggagaggaaagcggaattcctagtgtagcggtgaaatgcgtagatattaggaggaacaccagtggcgaaggcggctttctggactgtaactgacactgaggcatgaaagcgtgggtagcaaacaggattagataccctggtagtccacgccgtaaacgatgggtactaggtgtaggaggtatcgaccccttctgtgccgtcgttaacacaataagtaccccgcctggggagtacggtcgcaagactaaaactcaaaggaattgacgggggcccgcacaagcagcggagcatgtggtttaattcgaagcaacgcgaagaaccttacctagacttgacatctcctgaattacccttaaccggggaagcccttcggggcaggaagacaggtggtgcatggttgtcgtcagctcgtgtcgtgagatgttgggttaagtcccgcaacgagcgcaacccttatttttagttgctaccattcagttgagcactctaaagagactgcccgggttaaccgggaggaaggtggggatgacgtcaaatcatcatgccccttatgtctagggctacacacgtgctacaatggtgagaacaaagagacgcgagaccgcgaggtggagcaaatctcataaaactcatcccagttcggattgcaggctgaaactcgcctgcatgaagccggagttgctagtaatcgcgaatcagcatgtcgcggtgaatacgttcccgggccttgtacacaccgcccgtcacaccatgagagttggcaatacccgaagtccgtggggcaaccagtaatggagccagcggccgaaggtagggtcagcgattggggtgaagtcgtaacaaggtagccgtaggagaacctgcggctggatcacctcctttcta

SEQ ID NO: 6893 - DNA, 953 bp, Proteus genomosp. 4
  ref <308>: DATABASE ACCESSION NUMBER: NCBI ACCESSION: NZ_PENV01000046.1
  ref <309>: DATABASE ENTRY DATE: 2019-04-01
  ref <313>: RELEVANT RESIDUES IN SEQ ID NO: (1)..(953)
gaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgcctt

SEQ ID NO: 6894 - DNA, 830 bp, Proteus genomosp. 6
  ref <308>: DATABASE ACCESSION NUMBER: NCBI ACCESSION: NZ_PENT01000036.1
  ref <309>: DATABASE ENTRY DATE: 2019-04-01
  ref <313>: RELEVANT RESIDUES IN SEQ ID NO: (1)..(830)
aattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggag

SEQ ID NO: 6895 - DNA, 1553 bp, Proteus hauseri
  ref <308>: DATABASE ACCESSION NUMBER: NCBI ACCESSION: NZ_CP026364.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacagaggaaagcttgctttcttgctgacgagcggcggacgggtgagtaatgtatggggatctgcccgatagagggggataactactggaaacggtagctaataccgcatgacgtctacggaccaaagcaggggctcttcggaccttgcgctatcggatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgttaagattaatactcttagcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgccttcgggaactctgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6896 - DNA, 1553 bp, Proteus mirabilis
  ref <308>: DATABASE ACCESSION NUMBER: NCBI ACCESSION: NZ_LR134205.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatactcttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6897 - DNA, 1553 bp, Proteus penneri
  ref <308>: DATABASE ACCESSION NUMBER: NCBI ACCESSION: NZ_UGTQ01000009.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacagaagaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagtgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6898 - DNA, 1253 bp, Proteus sp. CA142267
  ref <308>: DATABASE ACCESSION NUMBER: NCBI ACCESSION: NZ_QPMG01000023.1
  ref <309>: DATABASE ENTRY DATE: 2019-04-01
  ref <313>: RELEVANT RESIDUES IN SEQ ID NO: (1)..(1253)
gctaataccgcatgacgtctacggaccaaagcaggggctcttcggaccttgcgctatcggatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgttaagattaatactcttagcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggag

SEQ ID NO: 6899 - DNA, 1553 bp, Proteus sp. TJ1636
  ref <308>: DATABASE ACCESSION NUMBER: NCBI ACCESSION: NZ_PENZ01000023.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6900 - DNA, 1553 bp, Proteus sp. TJ1640
  ref <308>: DATABASE ACCESSION NUMBER: NCBI ACCESSION: NZ_PENY01000043.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacagaagaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6901 - DNA, 1476 bp, Proteus terrae
  ref <308>: DATABASE ACCESSION NUMBER: NCBI ACCESSION: NZ_PENS01000031.1
  ref <309>: DATABASE ENTRY DATE: 2019-04-01
  ref <313>: RELEVANT RESIDUES IN SEQ ID NO: (1)..(1476)
agaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtggggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgttaagattaatactcttagcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgccttcgggaactctgagacaggtgctgcatggctgtcgtcagctcgtgttgtgaaatgttgggttaagtcccgcaacgagcgcaacccttatcctttgttgccagcgtgtaatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6902 - DNA, 1553 bp, Proteus vulgaris
  ref <308>: DATABASE ACCESSION NUMBER: NCBI ACCESSION: NZ_UGTW01000001.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcatgacgtctacggaccaaagcaggggctcttcggaccttgcgctatcggatgaacccatatgggattagctagtaggtgaggtaatggctcacctaggcaacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 6903 - DNA, 1518 bp, Provencibacterium massiliense
  ref <308>: DATABASE ACCESSION NUMBER: NCBI ACCESSION: NZ_FWCH01000011.1
  ref <309>: DATABASE ENTRY DATE: 2019-04-01
  ref <313>: RELEVANT RESIDUES IN SEQ ID NO: (1)..(1518)
atttctaaagagtttgatcctggctcaggacgaacgctggcggcgcgcctaacacatgcaagtcgaacggagaaatgctgagcttgctttgcattttttagtggcggacgggtgagtaacacgtgagcaacctgcctttgtgaggggaataacgtctggaaacggacgctaataccgcataacgtcaaggaaccgcatggttttttgaccaaagattttatcgcaaaaagatgggctcgcggctgattagctagttggcggggtaacggcccaccaaggcgacgatcagtagccggactgagaggttgatcggccacattgggactgagacacggcccagactcctacgggaggcagcagtgggggatattgcacaatgggggaaaccctgatgcagcgacgccgcgtgagggaagacggttttcggattgtaaacctctgtcttcagggacgaaatcaatgacggtacctgaggaggaagccacggctaactacgtgccagcagccgcggtaatacgtaggtggcaagcgttgtccggaattactgggtgtaaagggagcgtaggcgggaatgcaagttgaatgtttaaactatcggctcaactgataatcgcgttcaaaactgcatttcttgagtggagtagaggcaggcggaattcctagtgtagcggtgaaatgcgtagatattaggaggaacaccagtggcgaaggcggcctgctgggctctaactgacgctgaggctcgaaagcgtgggtagcaaacaggattagataccctggtagtccacgccgtaaacgatgattactaggtgtggggggactgaccccttccgtgccggagttaacacaataagtaatccacctggggagtacggtcgcaagactgaaactcaaaggaattgacgggggcccgcacaagcagtggagtatgtggtttaattcgaagcaacgcgaagaaccttaccaggtcttgacatcgtgcgcataccgtagagatacgggaagtccttcgggacgcatagacaggtggtgcatggttgtcgtcagctcgtgtcgtgagatgttgggttaagtcccgcaacgagcgcaacccttattattagttgctacgcaagagcactctaatgagactgccgttgacaaaacggcggaaggtggggatgacgtcaaatcatcatgccccttatgacctgggctacacacgtactacaatggcacttaacagagggaagcaagaccgcgaggtggagcaaacccccaaaaagtgtctcagttcggattgcaggctgcaacccgcctgtatgaagtcggaattgctagtaatcgcggatcagcatgccgcggtgaatacgttcccgggccttgtacacaccgcccgtcacaccatgagagccggtaacacccgaagtcagtagcctaaccgcaaggagggcgctgccgaaggtgggattggtgattagggtgaagtcgtaacaaggtagccgtatcggaaggtgcggctggatcacctcctttcta

SEQ ID NO: 6904 - DNA, 1544 bp, Providencia rustigianii
  ref <308>: DATABASE ACCESSION NUMBER: NCBI ACCESSION: NZ_LR134396.1
  ref <309>: DATABASE ENTRY DATE: 2019-04-01
  ref <313>: RELEVANT RESIDUES IN SEQ ID NO: (1)..(1544)
ttaattgaagagtttgatcatggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctaaggagcaaagcaggggaacttcggtccttgcgctatcggatgaacccatatgggattagctagttggtggggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcagcgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 6905 - DNA, 1543 bp, Providencia sp. WCHPr000369
  ref <308>: DATABASE ACCESSION NUMBER: NCBI ACCESSION: NZ_CP031123.1
  ref <309>: DATABASE ENTRY DATE: 2019-04-01
  ref <313>: RELEVANT RESIDUES IN SEQ ID NO: (1)..(1543)
ttaattgaagagtttgatcatggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctcttaggagcaaagcaggggaacttcggtccttgcgctatcggatgaacccatatgggattagctagttggtgaggtaatggctcaccaaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgctaatatcatcaacgattgacgttaccgacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttgaaggttgttccctagaggagtggctttcggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 6906 - DNA, 1532 bp, Pseudacidovorax intermedius
  ref <308>: DATABASE ACCESSION NUMBER: NCBI ACCESSION: NZ_QQAV01000023.1
  ref <309>: DATABASE ENTRY DATE: 2019-04-01
  ref <313>: RELEVANT RESIDUES IN SEQ ID NO: (1)..(1532)
gaactgtagagtttgatcctggctcagattgaacgctggcggcatgccttacacatgcaagtcgaacggtaacaggccgcaaggtgctgacgagtggcgaacgggtgagtaatacatcggaacgtgcccgatcgtgggggataacgcagcgaaagctgtgctaataccgcatacgatctacggatgaaagcgggggatcgcaagacctcgcgcggacggagcggccgatggcagattaggtagttggtggggtaaaggcctaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggtttcttttaatacagggaactgatgacggtaccgtaagaataagcaccggctaactacgtgccagcagccgcggtaatacgtagggtgcgagcgttaatcggaattactgggcgtaaagcgtgcgcaggcggtgatgtaagacagaggtgaaatccccgggctcaacctgggaactgcctttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaattagttttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggctggatcacctcctttctg

SEQ ID NO: 6907 - DNA, 1467 bp, Pseudaestuariivita atlantica
  ref <308>: DATABASE ACCESSION NUMBER: NCBI ACCESSION: NZ_AQQZ01000002.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggttagtaacgcgtgggaacgtgcccttcactaaggaatagccactggaaacggtgagtaataccttatacgcccttcgggggaaagatttatcggtgaaggatcggcccgcgttagattaggtagttggtggggtaatggcctaccaagcctacgatctatagctggttttagaggacgatcagcaacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggaccattaagtcaggggtgaaatcccggggctcaaccccggaactgcccttgatactggtggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggtagtgacaatgggttaatcccaaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 6908 - DNA, 1495 bp, Pseudaminobacter manganicus
  ref <308>: DATABASE ACCESSION NUMBER: NCBI ACCESSION: NZ_MDET01000007.1
  ref <309>: DATABASE ENTRY DATE: 2019-04-01
  ref <313>: RELEVANT RESIDUES IN SEQ ID NO: (1)..(1495)
ttaaacatgagagtttgatcctggctcagaacgaacgctggcggcaggcttaacacatgcaagtcgagcgcccttttcggagggagcggcagacgggtgagtaacgcgtgggaatctacccagccctacggaataacccagggaaacttggactaataccgtatacgtccttcgggagaaagatttatcggggttggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcagcaagttaggggtgaaatcccggggctcaaccccggaactgcctttaaaactgctggtctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaactatgagagctagccgttggcaggtttacctgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggttacgagagatcgtatccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccgtaggggaacctgcggctggatcacctcctttctaagg

SEQ ID NO: 6909 - DNA, 1490 bp, Pseudaminobacter salicylatoxidans
  ref <308>: DATABASE ACCESSION NUMBER: NCBI ACCESSION: NZ_QGGG01000033.1
  ref <309>: DATABASE ENTRY DATE: 2019-04-01
  ref <313>: RELEVANT RESIDUES IN SEQ ID NO: (1)..(1490)
tcaacatgagagtttgatcctggctcagaacgaacgctggcggcaggcttaacacatgcaagtcgagcgccccgcaaggggagcggcagacgggtgagtaacgcgtgggaatctacccagccctacggaataacccagggaaacttggactaataccgtatacgtccgataggagaaagatttatcggggttggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcggtcagttaggggtgaaatcccagggctcaaccctggaactgcctttaatactgctggtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatggaagccagctgtcggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttacgagagatcgtttccttcagttcggctggaccggtgacaggtgctgcatggctgtcgtcagctcgtgtcgtgagatgttgggttaagtcccgcaacgagcgcaaccctcgcctttagttgccatcattcagttgggcactctaaagggactgccggtgataagccggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttctaag

SEQ ID NO: 6910 - DNA, 1490 bp, Pseudaminobacter sp. CB3
  ref <308>: DATABASE ACCESSION NUMBER: NCBI ACCESSION: NZ_ML133515.1
  ref <309>: DATABASE ENTRY DATE: 2019-04-01
  ref <313>: RELEVANT RESIDUES IN SEQ ID NO: (1)..(1490)
tcaacttgagagtttgatcctggctcagaacgaacgctggcggcaggcttaacacatgcaagtcgagcgccccgcaaggggagcggcagacgggtgagtaatgcgtgggaatctacccagctctacggaataacccagggaaacttggactaataccgtatacgtccgataggagaaagatttatcggagttggatgagcccacgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatggaagctagctgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtttccttcagttaggctggatcggtgacaggtgctgcatggctgtcgtcagctcgtgtcgtgagatgttgggttaagtcccgcaacgagcgcaaccctcgcctttagttgccatcatttggttgggcactctaaagggactgccggtgataagccggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttctaag

SEQ ID NO: 6911 - DNA, 1484 bp, Pseudanabaena biceps
  ref <308>: DATABASE ACCESSION NUMBER: NCBI ACCESSION: NZ_ALWB01000102.1
  ref <309>: DATABASE ENTRY DATE: 2019-04-01
  ref <313>: RELEVANT RESIDUES IN SEQ ID NO: (1)..(1484)
catggagagtttgatcctggctcaggatgaacgctggcggtatgcttaacacatgcaagtcgaacggaatcttcggatttagtggcggacgggtgagtaacgcgtaagaatctacctataggttcgggacaacagttagaaatgactgctaataccggatatgccttcgggtgaaagttttaatgcctgtagatgagcttgcgttcgattagctagatggtggggtaaaggcctaccatggcgacgatcgataactggtctgagaggatgaccagtcacactgggactgagacacggcccagactcctacgggaggcagcagtggggaattttccgcaatgggcgaaagcctgacggagcaataccgcgtgagggacgaaggcctgtgggttgtaaacctcttttgttagggaagataatgacggtacctaacgaataagcatcggctaactccgtgccagcagccgcggtaagacggaggatgcaagcgttatccggaattattgggcgtaaagcgtacgtaggctgtttgataagtctgttgtcaaagcccgaggctcaaccttggatcggcaatggaaactgtgagactagagagagataggggcaggaggaattccaggtgtagcggtgaaatgcgtagatatctggaagaacaccagtggcgaaagcgtcctgctggatctcaactgacgctgaagtacgaaagctaggggagcgaatgggattagataccccagtagtcctagccgtaaacgatgggtactaggtgttggccgtatcgacccggtcagtgccgtagctaacgcgttaagtaccccgcctggggagtacggtcgcaagattgaaactcaaaggaattgacgggggcccgcacaagcggtggagtatgtggtttaattcgatgcaacgcgaagaaccttaccaaggcttgacatgtcgtgaatcctcttgaaagggaggagtgccttcgggagcacgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgccttgggctacacacgtactacaatggccgggacaaagagtcgcgagcatgcgaatgcaagctaatctcgtaaacccggtcttagttcagattgcaggctgcaactcgcctgcatgaaggcggaatcgctagtaatcgcaggtcagcatactgcggtgaatacgttcccgggccttgtacacaccgcccgtcacaccatggaagctggtcacgcccgaagtcgttatctcaacccgtaagggagggaggcgcctaaggcagggctggtgactggggtgaagtcgtaacaaggtagccgtaccggaaggtgcggctggatcacctcctta

SEQ ID NO: 6912 - DNA, 1484 bp, Pseudanabaena sp. ABRG5-3
  ref <308>: DATABASE ACCESSION NUMBER: NCBI ACCESSION: NZ_AP017560.1
  ref <309>: DATABASE ENTRY DATE: 2019-04-01
  ref <313>: RELEVANT RESIDUES IN SEQ ID NO: (1)..(1484)
catggagagtttgatcctggctcaggatgaacgctggcggtatgcttaacacatgcaagtcgaacgggtacttcggtacaagtggcggacgggtgagtaacgcgtaagaatctacctataggttcgggacaacagttagaaatgactgctaataccggatgtgccttcgggtgaaagtttaaatgcctgtagatgagcttgcgtccgattagctagatggagtggtaacggcacaccatggcgacgatcggtaactggtctgagaggatgaccagtcacactggaactgagacacggtccagactcctacgggaggcagcagtggggaattttccgcaatgggcgaaagcctgacggagcaataccgcgtgagggacgaaggtctgtggattgtaaacctcttttgttagggaagataatgacggtacctaacgaataagcatcggctaactccgtgccagcagccgcggtaagacggaggatgcaagcgttatccggaattattgggcgtaaagcgtacgtaggctgttttataagtctgttgtcaaagcccgaggctcaaccttggaaaggcaatggaaactgtgagactagagagagataggggcaggaggaattccaggtgtagcggtgaaatgcgtagatatctggaagaacaccagtggcgaaagcgtcctgctggatctcaactgacgctgaagtacgaaagctaggggagcgaatgggattagataccccagtagtcctagccgtaaacgatgggtactaggtgttggccgtatcgacccggtcagtgccgtagctaacgcgttaagtaccccgcctggggagtacggtcgcaagattgaaactcaaaggaattgacgggggcccgcacaagcggtggagtatgtggtttaattcgatgcaacgcgaagaaccttaccaaggcttgacatgtcgcgaatcctcttgaaagggaggagtgccttcgggagcgcgaacacaggtggtgcatggctgtcgtcagctcgtgtcgtgagatgttgggttaagtcccgcaacgagcgcaaccctcgtatttagttgccatcattaagttgggcactctagatagactgccggtgacaaaccggaggaaggtggggatgacgtcaagtcatcatgccccttacgccttgggctacacacgtactacaatggccgggacaaagagtcgcgagcatgcgaatgcaagctaatctcataaacccggtcttagttcagattgcaggctgcaactcgcctgcatgaaggcggaatcgctagtaatcgcaggtcagcatactgcggtgaatacgttcccgggccttgtacacaccgcccgtcacaccatggaagctggtcacgcccgaagtcgttatctcaaccgttcgcggagggaggcgcctaaggcagggctggtgactggggtgaagtcgtaacaaggtagccgtaccggaaggtgcggctggatcacctcctta

SEQ ID NO: 6913 - DNA, 1484 bp, Pseudanabaena sp. BC1403
  ref <308>: DATABASE ACCESSION NUMBER: NCBI ACCESSION: NZ_PDDM01000058.1
  ref <309>: DATABASE ENTRY DATE: 2019-04-01
  ref <313>: RELEVANT RESIDUES IN SEQ ID NO: (1)..(1484)
catggagagtttgatcctggctcaggatgaacgctggcggtatgcttaacacatgcaagtcgaacgaagtcttcggacttagtggcggacgggtgagtaacgcgtaagaatctacctataggttcgggacaacagttagaaatgactgctaataccggatatgccttcgggtgaaagttttaatgcctgtagatgagcttgcgttcgattagctagatggtggggtaacggcctaccatggcgacgatcgataactggtctgagaggatgaccagtcacactgggactgagacacggcccagactcctacgggaggcagcagtggggaattttccgcaatgggcgaaagcctgacggagcaataccgcgtgagggacgaaggcctgtgggttgtaaacctcttttgttagggaagataatgacggtacctaacgaataagcatcggctaactccgtgccagcagccgcggtaagacggaggatgcaagcgttatccggaattattgggcgtaaagcgtacgtaggctgctaattaagtctgttgtcaaagcccgaggctcaaccttggatcggcaatggaaactgaatagctagagagagataggggcaggaggaattccaggtgtagcggtgaaatgcgtagatatctggaagaacaccagtggcgaaagcgtcctgctggatctcaactgacgctgaagtacgaaagctaggggagcgaatgggattagataccccagtagtcctagccgtaaacgatgggtactaggtgttggccgtatcgacccggtcagtgccgtagctaacgcgttaagtaccccgcctggggagtacggtcgcaagattgaaactcaaaggaattgacgggggcccgcacaagcggtggagtatgtggtttaattcgatgcaacgcgaagaaccttaccaaggcttgacatgtcgtgaatcctcttgaaagggaggagtgccttcgggagcacgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgccttgggctacacacgtactacaatggccgggacaaagagttgcgagcatgcgaatgcaagctaatctcataaacccggtcttagttcagattgcaggctgcaactcgcctgcatgaaggcggaatcgctagtaatcgcaggtcagcatactgcggtgaatacgttcccgggccttgtacacaccgcccgtcacaccatggaagctggtcacgcccgaagtcgttatctcaacccgcaagggagggaggcgcctaaggcagggctggtgactggggtgaagtcgtaacaaggtagccgtaccggaaggtgcggctggatcacctcctta

SEQ ID NO: 6914 - DNA, 1486 bp, Pseudanabaena sp. PCC 6802
  ref <308>: DATABASE ACCESSION NUMBER: NCBI ACCESSION: NZ_KB235914.1
  ref <309>: DATABASE ENTRY DATE: 2019-04-01
  ref <313>: RELEVANT RESIDUES IN SEQ ID NO: (1)..(1486)
catggagagtttgatcctggctcaggatgaacgctggcggtatgcttaacacatgcaagtcgaacgcttgtagcaatacaagagtggcggacgggtgagtaacgcgtaagaatctggctccaggttcgggacaacggctggaaacggccgctaataccggatgtgccgagaggtgaaagctttagtgcctggagatgagcttgcgtctgattagctagttggagtggtaacggcacaccaaggcgacaatcagtaactggtctgagaggatgaccagtcacactgggactgagacacggcccagactcctacgggaggcagcagtggggaattttccgcaatgggcgaaagcctgacggagcaataccgcgtgagggaagaaggtctgtggattgtaaacctcttttgttagggacgataatgacggtacctaacgaataagcctcggctaactccgtgccagcagccgcggtaagacggaggaggcaagcgttatccggaattattgggcgtaaagcgtacgcaggtgggttgacaagtcttatgtcaaagaccggggcttaaccccgggaaggcataggaaactgttaatctagagtgcggtaggggcaggaggaattcccggtgtagcggtgaaatgcgtagatatcgggaagaacaccagcggcgaaagcgtcctgctaggccgtaactgacactcatgtacgaaagctaggggagcgaatgggattagataccccagtagtcctagccgtaaacgatggatactaggtgtagcgagtatcgaccctcgctgtgccgtagctaacgcgttaagtatcccgcctggggagtacggtcgcaagattgaaactcaaaggaattgacgggggcccgcacaagcggtggagtatgtggtttaattcgatgcaacgcgaagaaccttaccagggcttgacatgtcgcgaatccctctgaaaggagggagtgccttcgggagcgcgaacacaggtggtgcatggctgtcgtcagctcgtgtcgtgagatgttgggttaagtcccgcaacgagcgcaacccacgtttttagttgccagcattaagttgggcactctagagagactgccggtgacaaaccggaggaaggtgtggatgacgtcaagtcagcatgccccttacgtcctgggctacacacgtactacaatggctgggacagagagttgcaagttcgcgaggacaagctaatctcataaactcagtcttagttcagatcgcaggctgcaactcgcctgcgtgaaggcggaatcgctagtaatcgcagatcagaatgctgcggtgaatacgttcccgggccttgtacacaccgcccgtcacaccatggaagctggtcacgcccgaagtcgttatcctaacccttgtggagggagacgcctaaggcagggctggtgactggggtgaagtcgtaacaaggtagccgtaccggaaggtgcggctggatcacctcctttt

SEQ ID NO: 6915 - DNA, 1491 bp, Pseudanabaena sp. PCC 7367
  ref <308>: DATABASE ACCESSION NUMBER: NCBI ACCESSION: NC_019701.1
  ref <309>: DATABASE ENTRY DATE: 2019-04-01
  ref <313>: RELEVANT RESIDUES IN SEQ ID NO: (1)..(1491)
aatggagagtttgatcctggctcaggatgaacgctggcggcatgcctaacacatgcaagtcgaacgagcttttaggagctagtggcggacgggtgagtaacgcgtaagaatctgcccttaggttcgggacaacagagggaaacttctgctaataccggatgtgccgagaggtaaaagattaattgcctaaggatgagcttgcgtctgattagctagttggtggggtaagagcctgccaaggcaacaatcagtaactggtctgagaggatgaccagtcacactgggactgagacacggcccagactcctacgggaggcagcagtggggaattttccgcaatgggcgaaagcctgacggagcaatgccgcgtgagggaagaaggcctgtgggtcgtaaacctcttttgtcagggaagaagaaagtgacggtacctgacgaatcagcctcggctaactccgtgccagcagccgcggtaagacggaggaggcaagcgttatccggaattattgggcgtaaagcgtacgcaggtggctaatcaagtctgctattaaagaccagggcttaactctgggagggtagtagaaactgaatggctagagtacggtaggggtaggaggaattcccggtgtagcggtgaaatgcgtagatatcgggaagaacaccagcagcgaaagcgtcctaccaggccgaaactgacactgaggtacgaaagctaggggagcgaatgggattagataccccagtagtcctagccgtaaacgatggatactaggtgtggcttgtatcgacccaagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcctgctaaaaggtaggagtgccttcgggagcgcgaacacaggtggtgcatggctgtcgtcagctcgtgtcgtgagatgttgggttaagtcccgcaacgagcgcaacccacgtttttagttgccatcattaagttgggcactctagagagactgccggtgacaaaccggaggaaggtgtggacgacgtcaagtcatcatgccccttacgttctgggctacacacgtactacaatggtagggacaaagagtcgccaatccgcgaggacgcgctaatctcataaaccctatcccagttcagatcgcaggctgcaactcgcctgcgtgaagtaggaatcgctagtaatcgcagatcagaatgctgcggtgaatacgttcccgggccttgtacacaccgcccgtcacaccatgggagctggtcacgcccgaagtcgttatcctaacctacgggagggaggcgcctaaggcagggctggtgactggggtgaagtcgtaacaaggtagccgtaccggaaggtgcggctggatcacctccttttaagga

SEQ ID NO: 6916 - DNA, 1484 bp, Pseudanabaena sp. Roaring Creek
  ref <308>: DATABASE ACCESSION NUMBER: NCBI ACCESSION: NZ_LIRE01000034.1
  ref <309>: DATABASE ENTRY DATE: 2019-04-01
  ref <313>: RELEVANT RESIDUES IN SEQ ID NO: (1)..(1484)
catggagagtttgatcctggctcaggatgaacgctggcggtatgcttaacacatgcaagtcgaacggaatcttcggatttagtggcggacgggtgagtaacgcgtaagaatctacctataggttcgggacaacagttagaaatgactgctaataccggatatgccttcgggtgaaagttttaatgcctgtagatgagcttgcgttcgattagctagatggtggggtaaaggcctaccatggcgacgatcgataactggtctgagaggatgaccagtcacactgggactgagacacggcccagactcctacgggaggcagcagtggggaattttccgcaatgggcgaaagcctgacggagcaataccgcgtgagggacgaaggcctgtgggttgtaaacctcttttgttagggaagataatgacggtacctaacgaataagcatcggctaactccgtgccagcagccgcggtaagacggaggatgcaagcgttatccggaattattgggcgtaaagcgtacgtaggctgtttgataagtctgttgtcaaagcccgaggcttaaccttggaaaggcaatggaaactgtgagactagagagagataggggcaggaggaattccaggtgtagcggtgaaatgcgtagatatctggaagaacaccagtggcgaaagcgtcctgctggatctcaactgacgctgaagtacgaaagctaggggagcgaatgggattagataccccagtagtcctagccgtaaacgatgggtactaggtgttggccgtatcgacccggtcagtgccgtagctaacgcgttaagtaccccgcctggggagtacggtcgcaagattgaaactcaaaggaattgacgggggcccgcacaagcggtggagtatgtggtttaattcgatgcaacgcgaagaaccttaccaaggcttgacatgtcgcgaatcctcttgaaagggaggagtgccttcgggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgccttgggctacacacgtactacaatggccgggacaaagagtcgcgagcatgcgaatgcaagctaatctcgtaaacccggtcttagttcagattgcaggctgcaactcgcctgcatgaaggcggaatcgctagtaatcgcaggtcagcatactgcggtgaatacgttcccgggccttgtacacaccgcccgtcacaccatggaagctggtcacgcccgaagtcgttatctcaacccgtaagggagggaggcgcctaaggcagggctggtgactggggtgaagtcgtaacaaggtagccgtaccggaaggtgcggctggatcacctcctta

SEQ ID NO: 6917 - DNA, 1509 bp, Pseudarcicella sp. HME7025
  ref <308>: DATABASE ACCESSION NUMBER: NCBI ACCESSION: NZ_CP029346.1
  ref <309>: DATABASE ENTRY DATE: 2019-04-01
  ref <313>: RELEVANT RESIDUES IN SEQ ID NO: (1)..(1509)
tttacaatggagagtttgatcctggctcaggatgaacgctagcggcaggcctaatacatgcaagtcgaacggtgtagcaatacacagtggcgcacgggtgcgtaacacgtatgcaacctaccttacattgggggatagcctttcgaaagggagattaataccgcataagacagtaactaggcatctagtagctgttaaagatttatcgatgtaagctgggcatgcgtccaattagttagttggcgaggtaatggctcaccaagacgatgattggtaggggaactgagaggtcaatcccccacactggcactgagatacgggccagactcctacgggaggcagcagtagggaatattgggcaatgggcgcaagcctgacccagccatgccgcgtgcaggaagaaggcgttatgcgttgtaaactgcttttatacaggaagaaacgacccttgcgaggggcattgacggtactgtatgaataagcaccggctaactccgtgccagcagccgcggtaatacggagggtgcaagcgttgtccggatttattgggtttaaagggtgcgcaggtggtttattaagtcagtggtgaaagacggtcgctcaacgattgcagtgccattgatactggtagacttgagtaaagtagaggtgggcggaattgatagtgtagcggtgaaatgcatagatattatcaagaactccaattgcgtaggcagctcacttggcttttactgacactcatgcacgaaagtgtgggtatcaaacaggattagataccctggtagtccacactgtaaacgatgataactaggtgtcggcttttcggagtcggtgccacagcgaaagcgttaagttatccacctggggagtacgccggcaacggtgaaactcaaaggaattgacgggggtccgcacaagcggtggagcatgtggtttaattcgatgatacgcgaggaaccttacctaggctagaatgtgaaggaatgatacagaaatggatcagtcagcaatgacctgaaacaaggtgctgcatggctgtcgtcagctcgtgccgtgaggtgttgggttaagtcccgcaacgagcgcaacccctgcatttagttgccagcacgtaatggtggggactctaaatggactgcctacgcaagtagagaggaaggaggggacgacgtcaagtcatcatggcccttacgcctagggctacacacgtgctacaatgggcggtacagagggtagctacctggtaacaggatgccaatctcgaaagccgctcacagttcggattggggtctgcaactcgaccctatgaagctggaatcgctagtaatcgcgtatcagcaatgacgcggtgaatacgttcccggaccttgtacacaccgcccgtcaagccatgaaagtctggtagacctgaagctggccgttaaaccgccagttagggtagaacaggtaattggggctaagtcgtaacaaggtagccgtaccggaaggtgtggctggaacacctccttt

SEQ ID NO: 6918 - DNA, 1171 bp, Pseudarthrobacter phenanthrenivorans
  ref <308>: DATABASE ACCESSION NUMBER: NCBI ACCESSION: NZ_RBNH01000046.1
  ref <309>: DATABASE ENTRY DATE: 2019-04-01
  ref <313>: RELEVANT RESIDUES IN SEQ ID NO: (1)..(1171)
tattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaacgcctggagacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 6919 - DNA, 1532 bp, Pseudarthrobacter phenanthrenivorans
tcaacggagagtttgatcctggctcaggatgaacgctggcggcgtgcttaacacatgcaagtcgaacgatgatcctcagcttgctggggggattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaagacctggaaacaggtcccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 6920 - DNA, 1442 bp, Pseudarthrobacter phenanthrenivorans
gattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaatacctggagacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 6921 - DNA, 1531 bp, Pseudarthrobacter sp. AG30
  ref <308>: DATABASE ACCESSION NUMBER: NCBI ACCESSION: NZ_QEHL01000036.1
  ref <309>: DATABASE ENTRY DATE: 2019-04-01
  ref <313>: RELEVANT RESIDUES IN SEQ ID NO: (1)..(1531)
tcaacggagagtttgatcctggctcaggatgaacgctggcggcgtgcttaacacatgcaagtcgaacgatgaactggtgcttgcactggggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaatacctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 6922 - DNA, 1534 bp, Pseudarthrobacter sp. T11b
  ref <308>: DATABASE ACCESSION NUMBER: NCBI ACCESSION: NZ_UXAU01000019.1
  ref <309>: DATABASE ENTRY DATE: 2019-04-01
  ref <313>: RELEVANT RESIDUES IN SEQ ID NO: (1)..(1534)
tcaacggagagtttgatcctggctcaggatgaacgctggcggcgtgcttaacacatgcaagtcgaacgatgatccctagcttgctggggggattagtggcgaacgggtgagtaacacgtgagtaacctgcccttgactctgggataagcctgggaaactgggtctaataccggatatgactcctcatcgcatggtggggggtggaaagcttttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaactagtaaggcgcagagatgcgtcccccactttgtggctggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 6923 - DNA, 1542 bp, Pseudoalteromonas sp. CO133X
  ref <308>: DATABASE ACCESSION NUMBER: NCBI ACCESSION: NZ_SGPE01000032.1
  ref <309>: DATABASE ENTRY DATE: 2019-04-01
  ref <313>: RELEVANT RESIDUES IN SEQ ID NO: (1)..(1542)
ttaattgaagagtttgatcatggctcagattgaacgctggcggcaggcctaacacatgcaagtcgagcggaaacgaagaggagcttgctcctttggcgtcgagcggcggacgggtgagtaatgcttgggaatgtgccttatggtgggggacaacagttggaaacgactgctaataccgcataatgtcttcggaccaaagtgggggaccttcgggcctcacgccataagatcagcccaagtgggattagctagttggtaaggtaatggcttaccaaggcgacgatccctagctggtttgagaggatgatcagccacactgggactgagacacggcccagactcctacgggaggcagcagtggggaatattgcacaatgggcgcaagcctgatgcagccatgccgcgtgtgtgaagaaggccttcgggttgtaaagcactttcagtaaggaggaaaggttaagtgttaatagcacttagctgtgacgttacttacagaagaagcaccggctaactccgtgccagcagccgcggtaatacggagggtgcgagcgttaatcggaattactgggcgtaaagcgtacgcaggcggtttgttaagcgagatgtgaaagccccgggctcaacctgggaactgcatttcgaactggcaaactagagtgtgatagagggtggtagaatttcaggtgtagcggtgaaatgcgtagagatctgaaggaataccgatggcgaaggcagccacctgggtcaacactgacgctcatgtacgaaagcgtggggagcaaacaggattagataccctggtagtccacgccgtaaacgatgtctactagaagctcgactcttcggagttgtttttcaaagctaacgcattaagtagaccgcctggggagtacggccgcaaggttaaaactcaaatgaattgacgggggcccgcacaagcggtggagcatgtggtttaattcgatgcaacgcgaagaaccttacctacacttgacatacagcgaacttactagagatagtttggtgccttcgggaacgctgatacaggtgctgcatggctgtcgtcagctcgtgttgtgagatgttgggttaagtcccgcaacgagcgcaacccctatccttagttgccagcgattcggtcgggaactctaaggagactgccggtgataaaccggaggaaggtggggacgacgtcaagtcatcatggcccttacgtgtagggctacacacgtgctacaatggcgcatacagagtgctgcgaacctgcgagggtaagcgaatcacttaaagtgcgtcgtagtccggattggagtctgcaactcgactccatgaagtcggaatcgctagtaatcgcatatcagaatgatgcggtgaatacgttcccgggccttgtacacaccgcccgtcacaccatgggagtgggttgctccagaagtggatagtctaaccttcgggaggacgttcaccacggagtgattcatgactggggtgaagtcgtaacaaggtagccctaggggaacctggggctggatcacctcctta

SEQ ID NO: 6924 - DNA, 1542 bp, Pseudoalteromonas sp. CO302Y; identical to SEQ ID NO: 6923
  ref <308>: DATABASE ACCESSION NUMBER: NCBI ACCESSION: NZ_SGPF01000030.1
  ref <309>: DATABASE ENTRY DATE: 2019-04-01
  ref <313>: RELEVANT RESIDUES IN SEQ ID NO: (1)..(1542)

SEQ ID NO: 6925 - DNA, 1075 bp, Pseudoalteromonas sp. T1lg23B
  ref <308>: DATABASE ACCESSION NUMBER: NCBI ACCESSION: NZ_PQBZ01000014.1
  ref <309>: DATABASE ENTRY DATE: 2019-04-01
  ref <313>: RELEVANT RESIDUES IN SEQ ID NO: (1)..(1075)
agctgtgacgttacttacagaagaagcaccggctaactccgtgccagcagccgcggtaatacggagggtgcgagcgttaatcggaattactgggcgtaaagcgtacgcaggcggtttgttaagcgagatgtgaaagccccgggcttaacctgggaactgcatttcgaactggcaaactagagtgtgatagagggtggtagaatttcaggtgtagcggtgaaatgcgtagagatctgaaggaataccgatggcgaaggcagccaccttgggtcaacactgacgctcatgtacgaaagcgtggggagcaaacaggattagataccctggtagtccacgccgtaaacgatgtctactagaagctgggctcttcggagaactttttcaaagctaacgcattaagtagaccgcctggggagtacggccgcaaggttaaaactcaaatgaattgacgggggcccgcacaagcggtggagcatgtggtttaattcgatgcaacgcgaagaaccttacctacacttgacatacagagaactttctagagatagatttggtgccttcgggaactctgatacaggtgctgcatggctgtcgtcagctcgtgttgtgagatgttgggttaagtcccgcaacgagcgcaacccctatccttagttgccagcgattcggtcgggaactctaaggagactgccggtgataaaccggaggaaggtggggacgacgtcaagtcatcatggcccttacgtgtagggctacacacgtgctacaatggcgtatacagagtgctgcgaacttgcgagagtaagcgaatcacttaaagtacgtcgtagtccggattggagtctgcaactcgactccatgaagtcggaatcgctagtaatcgcggatcagaatgccgcggtgaatacgttcccgggccttgtacacaccgcccgtcacaccatgggagtgggttgctccagaagtggatagtctaaccttcgggaggacgttcaccacggagtgattcatgactggggtgaagtcgtaacaaggtagccctaggggaacctggggctggatcacctccttatacgaa

SEQ ID NO: 6926 - DNA, 1518 bp, Pseudoarcobacter caeni
  ref <308>: DATABASE ACCESSION NUMBER: NCBI ACCESSION: NZ_MUXE01000030.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacggattatagcttgctataattgtcagctaagtggcgcacgggtgagtaatatataggtaatgtgccctagagaagaggataacagttggaaacgactgctaagactctatatgcctttaagacagaagtctgcaagggaaatatttatagctctaggatcagcctgtacagtatcagttagttggtgaggtaatggctcaccaagacaatgacacttaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgggaagataatgacggtaccatatgaataagcaccggctaactccgtgccagcagccgcggtaatacggagggtgcaagcgttactcggaatcactgggcgtaaagagcgtgtaggcggatatataagtcagaagtgaaatccaatagcttaactattgaactgcttttgaaactgtatatctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgcacactagttgttgtgaggctagaccttgcagtaatgcagttaacacattaagtgtgccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgtaagtaggaggaaggtgaggacgacgtcaagtcatcatggcccttacgtccagggctacacacgtgctacaatggggtatacaaagagccgcaatacagtgatgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaaatagctaccttccacagtggatttagcgactggggtgaagtcgtaacaaggtaaccgtaggagaacctgcggttggatcacctcctttc

SEQ ID NO: 6927 - DNA, 1521 bp, Pseudobacteroides cellulosolvens
  ref <308>: DATABASE ACCESSION NUMBER: NCBI ACCESSION: NZ_LGTC01000001.1
  ref <309>: DATABASE ENTRY DATE: 2019-04-01
  ref <313>: RELEVANT RESIDUES IN SEQ ID NO: (1)..(1521)
ttaatttgagagtttgatcctggctcaggacgaacgctggcggcgtgcctaacacatgcaagtcgagcggagatatttagcaatagatatcttagcggcggacgggtgagtaacgcgtgggtaacctgccttatacagggggataacacagggaaacttgtgctaataccgcataacacagctttgtggcatcacagagttgtcaaaggagcaatccggtataagatggacccgcgtccaattagctagttggtggtgtaacggaccaccaaggcgacgattggtagccgaactgagaggttgatcggccacattgggactgagacacggcccagactcctacgggaggcagcagtggggaatattgcacaatgggggaaaccctgatgcagcaacgccgcgtgaaggatgaaggttttcggatcgtaaacttctttgatgagggacgaataaatgacggtacctcaaaaacaagccacggctaactacgtgccagcagccgcggtaatacgtaggtggcaagcgttgtccggatttactgggtgtaaagggcgtgtaggcgggaatgtaagtcagatgtgaaactccgaagctcaacttcggaactgcatctgaaactatgtttcttgagtgatggagaggaaagcggtattcctagtgtagcggtgaaatgcgtagatattaggaggaacaccagtggcgaaggcggctttctggacattaactgacgctgaggcgcgaaagcgtggggagcaaacaggattagataccctggtagtccacgctgtaaacgatggatactaggtgtgggaggtatcgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgacgatggtagagataccatttcccttcggggcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagctaagccgcaaggtggagcaaatccccaaaaatagtcccagttcagattgtgggctgaaactcgcccacatgaagtcggaattgctagtaatggcaggtcagcatactgccgtgaatacgttcccgggccttgtacacaccgcccgtcacaccatgagagtctgcaacacccgaagtcagtagtctaaccgcaaggaggacgctgccgaaggtggggccgatgattggggtgaagtcgtaacaaggtagccgtatcggaaggtgcggctggatcacctcctttctaagga

SEQ ID NO: 6928 - DNA, 1495 bp, Pseudochrobactrum sp. AO18b
  ref <308>: DATABASE ACCESSION NUMBER: NCBI ACCESSION: NZ_ANNO01000005.1
  ref <309>: DATABASE ENTRY DATE: 2019-04-01
  ref <313>: RELEVANT RESIDUES IN SEQ ID NO: (1)..(1495)
ttcaacatgagagtttgatcctggctcagaacgaacgctggcggcaggcttaacacatgcaagtcgaacggtctcttcggaggcagtggcagacgggtgagtaatgcatgggaatctaccgttctctacggaataactcagggaaacttgtgctaataccgtatacgcccttttggggaaagatttatcggagaatgatgagcccatgttggattagctagttggtagggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatgcctatgaatgttagtggagacactttcagcctttcggggcgtaggacacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 6929 - DNA, 1495 bp, Pseudochrobactrum sp. B5; identical to SEQ ID NO: 6928
  ref <308>: DATABASE ACCESSION NUMBER: NCBI ACCESSION: NZ_MOYL01000011.1
  ref <309>: DATABASE ENTRY DATE: 2019-04-01
  ref <313>: RELEVANT RESIDUES IN SEQ ID NO: (1)..(1495)

SEQ ID NO: 6930 - DNA, 1528 bp, Pseudoclavibacter helvolus
tttacggagagtttgatcctggctcaggacgaacgctggcggcgtgcttaacacatgcaagtcgaacgatgaagcccagcttgctgggtggattagtggcgaacgggtgagtaacacgtgagcaacgtgcccataactctgggataacctccggaaacggtggctaatactggatatctaacacgatcgcatggtctgtgtttggaaagatttttttggttatggatcggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgtggtaggggagattggaattcctggtgtagcggtggaatgcgcagatatcaggaggaacaccgatggcgaaggcagatctctgggccattactgacgctgaggagcgaaagcatggggagcgaacaggattagataccctggtagtccatgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacgttcagaaatgttcgccccgcaaggtcggtatacaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggctggtacaatgggctgcaataccgcgaggtggagcgaatcccaaaaagccagtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccttttggagggagccgtcgaaggtgggatcggtaattaggactaagtcgtaacaaggtagccgtaccggaaggtgcggctggatcacctcctttctaagga

SEQ ID NO: 6931 - DNA, 1707 bp, Pseudoclostridium thermosuccinogenes
  ref <308>: DATABASE ACCESSION NUMBER: NCBI ACCESSION: NZ_NIOJ01000025.1
  ref <309>: DATABASE ENTRY DATE: 2019-04-01
  ref <313>: RELEVANT RESIDUES IN SEQ ID NO: (1)..(1707)
ttttatttgagagtttgatcctggctcaggacgaacgctggcggcgtgcctaacacatgcaagtcgagcggagtagagttcaacactgagtattcgagcgttggcaaaagttaagccagcgtcatgcacaaactaccttgttgatagacatatttaaaagaaagttttgtgcatcacgctaaattaagtgcctaacacaatgctatgactaaaacaagtcaaaatagtattgataagaaacgccacacttgagtgctgagtgttggactctacttagcggcggacgggtgagtaacgcgtgggcaacctgccttgcacagggggataacacagggaaacttgtgctaataccgcataacatcacggggaggcatcttcctgtgatcaaaggagaaatccggtgcaagatgggcccgcgtccgattagctagttggcggtgtaacggaccaccaaggcgacgatcggtagccgaactgagaggttgatcggccacattgggactgagacacggcccagactcctacgggaggcagcagtggggaatattgcgcaatggaggaaactctgacgcagcaacgccgcgtgaaggatgaaggtcttcggattgtaaacttctttgatgagggacgaaggaagtgacggtacctcaaaaacaagccacggctaactacgtgccagcagccgcggtaatacgtaggtggcgagcgttgtccggaattactgggtgtaaagggcgcgtaggcggggatgtaagtcagatgtgaaataccatggctcaaccgtggggctgcatctgaaactatgtttcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagtaaacacaataagtatcccacctggggagtacggccgcaaggttgaaactcaaaggaattgacgggggcccgcacaagcagtggagtatgtggtttaattcgaagcaacgcgaagaaccttaccagggcttgacatacagagggatatgtcagagatggcatagctcttcggagcctctgtacaggtggtgcatggttgtcgtcagctcgtgtcgtgagatgttgggttaagtcccgcaacgagcgcaacccttgttgttagttggtaacacgtaaaggtgaccactctaacgagactgccggtgacaaatcggaggaaggtggggacgacgtcaaatcatcatgccccttatgtcctgggctacacacgtactacaatggctacaacaaagggaagcgaagccgtaaggcggagcaaatccccaaaagtagtcccagttcggattgtgggctgcaacccgcccacatgaagtcggaattgctagtaatggcaggtcagcatactgccgtgaatacgttcccgggccttgtacacaccgcccgtcacaccatgagagtcagcaacacccgaagtcagtagcttaaccgcaaggagggcgctgccgaaggtggggccgatgattggggtgaagtcgtaacaaggtagccgtatcggaaggtgcggctggatcacctcctttctaagga

SEQ ID NO: 6932 - DNA, 1552 bp, Pseudodesulfovibrio aespoeensis
  ref <308>: DATABASE ACCESSION NUMBER: NCBI ACCESSION: NC_014844.1
  ref <309>: DATABASE ENTRY DATE: 2019-04-01
  ref <313>: RELEVANT RESIDUES IN SEQ ID NO: (1)..(1552)
aactggagagtttgatcctggctcagattgaacgctggcggcgtgcttaacacatgcaagtcgagcgagaaagttctcttcggagaatgagtagagcggcgcacgggtgagtaacgcgtggataatctaccctgaagatcgggataacagttggaaacgactgctaataccggatatcctgcatatttaactttatgtggtaaaggcggcctctatttataagctgccgctttgggatgagtccgcgtctcattagcttgttggtggggtaatggcctaccaaggctacgatgagtagctggtctgagaggatgatcagccacactgggactgaaacacggcccagactcctacgggaggcagcagtggggaatattgcgcaatgggggaaaccctgacgcagcgacgccgcgtgcgggaagaaggccttcgggtcgtaaaccgctgtcaggagggaagaaactgttagggtataatacgccctttcactgacggtacctccaaaggaagcaccggctaactccgtgccagcagccgcggtaatacggagggtgcgagcgttaatcggaatcactgggcgtaaagcgcacgtaggcggcgcatcaagtcaggcgtgaaagccctcggctcaaccggggaattgcgtttgaaactggtgcgctggagtctcggagaggttggcggaattccaggtgtaggagtgaaatccgtagatatctggaggaacaccggtggcgaaggcggccaactggacgagaactgacgctgaggtgcgaaagcgtgggtagcaaacaggattagataccctggtagtccacgctgtaaacgatggatattaggtgtcgggggttaccttcggtgccgcagttaacgcgttaaatatcccgcctggggagtacggtcgcaaggctgaaactcaaaggaattgacgggggcccgcacaagcggtggagtatgtggtttaattcgatgcaacgcgaagaaccttacctaggcttgacatcctgagaatcttcccgaaacggaggagtgctcttcggagaattcagtgacaggtgctgcatggctgtcgtcagctcgtgccgtgaggtgttgggttaagtcccgcaacgagcgcaacccctattgctagttgccatcacgtaatggtgggcactctagtgagactgcccgggtcaaccgggaggaaggtggggacgacgtcaagtcatcatggcccttacgcctagggctacacacgtactacaatggtgcacacaaagggcagcgagaccgcgaggtggagccaatcccaaaaaatgcatcccagtccggattgcagtctgcaactcgactgcatgaagttggaatcgctagtaattccggatcagcatgccggggtgaatacgttcccgggccttgtacacaccgcccgtcacaccacgaaagctggttctacccgacaacggcagactaaccctcgggaggtagtcgtctacggtagggctggtaattggggtgaagtcgtaacaaggtagccgtaggggaacctgcggctggatcacctccttta

SEQ ID NO: 6933 - DNA, 1555 bp, Pseudodesulfovibrio hydrargyri
  ref <308>: DATABASE ACCESSION NUMBER: NCBI ACCESSION: NZ_LKAQ01000004.1
  ref <309>: DATABASE ENTRY DATE: 2019-04-01
  ref <313>: RELEVANT RESIDUES IN SEQ ID NO: (1)..(1555)
aactggagagtttgatcctggctcagattgaacgctggcggcgtgcttaacacatgcaagtcgagcgagaaagctctcttcggagagtgagtagagcggcgcacgggtgagtaacgcgtggataatctgccctgaagatcgggataacagttggaaacggctgctaataccgtataatctgcatatttaactttatgtgggaaagatggcctctacttgtaagctatcacttttggatgagtccgcgtctcattagcttgttggtggggtaatggcctaccaaggcaacgatgagtagctggtctgagaggatgatcagccacactgggactgaaacacggcccagactcctacgggaggcagcagtggggaatattgcgcaatgggggaaaccctgacgcagcgacgccgcgtgtaggaagaaggccttcgggtcgtaaactactgtcaagagggaagaaaccgtagagcattaatacggctctgcgctgacggtacctctagaggaagcaccggctaactccgtgccagcagccgcggtaatacggagggtgcgagcgttaatcggaatcactgggcgtaaagcgtgcgtaggcggcgtatcaagtcaggcgtgaaagccctcggctcaaccggggaattgcgcttgaaactggtatgctagagtctcggagaggttggcggaattccaggtgtaggagtgaaatccgtagatatctggaggaacaccggtggcgaaggcggccaactggacgagtactgacgctgaggtacgaaagcgtgggtagcaaacaggattagataccctggtagtccacgctgtaaacgatggatattaggtgtcggggttttacttcggtgccgcagttaacgcgttaaatatcccgcctggggagtacggtcgcaaggctgaaactcaaaggaattgacgggggcccgcacaagcggtggagtatgtggtttaattcgatgcaacgcgaagaaccttacctaggcttgacatcctgagaaccctcccgaaaaggaggggtgcccttcggggaattcagtgacaggtgctgcatggctgtcgtcagctcgtgccgtgaggtgttgggttaagtcccgcaacgagcgcaacccctattgctagttgccatcacataatggtgggcactctagtgagaccgcccgggtcaaccgggaggaaggtggggatgacgtcaagtcatcatggcccttacgcctagggctacacacgtactacaatggtgcatacaaagggcagcgaaaccgcgaggtcgagccaatcccagaaaatgcatcccagtccggatcggagtctgcaactcgactccgtgaagttggaatcgctagtaatcccggatcagcatgccggggtgaatacgttcccgggccttgtacacaccgcccgtcacaccacgaaagctggttctacccgacaacggcggactaacccttcgggaggtagtcgtctacggtagggctggtgattggggtgaagtcgtaacaaggtagccgtaggggaacctgcggctggatcacctcctttata

SEQ ID NO: 6934 - DNA, 1553 bp, Pseudodesulfovibrio piezophilus
  ref <308>: DATABASE ACCESSION NUMBER: NCBI ACCESSION: NC_020409.1
  ref <309>: DATABASE ENTRY DATE: 2019-04-01
  ref <313>: RELEVANT RESIDUES IN SEQ ID NO: (1)..(1553)
aactggagagtttgatcctggctcagattgaacgctggcggcgtgcttaacacatgcaagtcgagcgagaaagctttcttcggagagtgagtagagcggcgcacgggtgagtaacgcgtggataatctaccctagagatcgggataacagttggaaacggctgctaataccgtataatcttcatatttaactttatgatgcaaagatggcctctatttataagctatcgctttgggatgagtccgcgtctcattagattgttggtggggtaatggcctaccaagtctacgatgagtagctggtctgagaggatgatcagccacactgggactgaaacacggcccagactcctacgggaggcagcagtggggaatattgcgcaatgggggaaaccctgacgcagcgacgccgcgtgtaggaagaaggccttcgggtcgtaaactactgtcaggagggaagaaactgttcgggagtaatatgcccgttcactgacggtacctccagaggaagcaccggctaactccgtgccagcagccgcggtaatacggagggtgcgagcgttaatcggaatcactgggcgtaaagcgtgcgtaggcggcgcagtcagtcaggcgtgaaagccctcggctcaaccgaggaattgcgtttgatactgctgtgctagagtctcggagaggttggcggaattccaggtgtaggagtgaaatccgtagatatctggaggaacaccggtggcgaaggcggccaactggacgagtactgacgctgaggtacgaaagcgtggggagcaaacaggattagataccctggtagtccacgccgtaaacgatggatattaggtgtcggggttaacacttcggtgccgcagttaacgcgttaaatatcccgcctggggagtacggtcgcaaggctgaaactcaaaggaattgacgggggcccgcacaagcggtggagtatgtggtttaattcgatgcaacgcgaagaaccttacctaggcttgacatcctgcgaatctcttttaaacgagagagtgcccttcggggaatgcagtgacaggtgctgcatggctgtcgtcagctcgtgccgtgaggtgttgggttaagtcccgcaacgagcgcaacccctattgctagttgccatcacataatggtgggcactctagtgagactgcccgggtcaaccgggaggaaggtggggacgacgtcaagtcatcatggcccttacgcctagggctacacacgtactacaatggtgcatacaaagggcagcgagaccgcgaggtggagccaatcccagaaaatgcatcccagtccggattggagtctgcaactcgactccatgaagttggaatcgctagtaatcccggatcagcatgccggggtgaatacgttcccgggccttgtacacaccgcccgtcacaccacgaaagctggttctacccgacaatggcagactaaccctcgggaggtagtcatctacggtagggctggtaattggggtgaagtcgtaacaaggtagccgtaggggaacctgcggctggatcacctccttta

SEQ ID NO: 6935 - DNA, 1554 bp, Pseudodesulfovibrio profundus
  ref <308>: DATABASE ACCESSION NUMBER: NCBI ACCESSION: NZ_LT907975.1
  ref <309>: DATABASE ENTRY DATE: 2019-04-01
  ref <313>: RELEVANT RESIDUES IN SEQ ID NO: (1)..(1554)
aactggagagtttgatcctggctcagattgaacgctggcggcgtgcttaacacatgcaagtcgagcgagaaagttctcttcggagaatgagtagagcggcgcacgggtgagtaacgcgtggataatctgccccgaagatcgggataacagttggaaacgactgctaataccgaatgttctgcatatttaactttatgtggtaaagatggcctctatttataagctatcgctttgggatgagtccgcgtctcattagatagttggtggggtaatggcctaccaagtcaacgatgagtagctggtctgagaggatgatcagccacactgggactgaaacacggcccagactcctacgggaggcagcagtggggaatattgcgcaatgggggaaaccctgacgcagcgacgccgcgtgcgggaagaaggccttcgggtcgtaaaccgctgtcaggagggaagaaactgttggagtcgaataggctctttcactgacggtacctccagaggaagcaccggctaactccgtgccagcagccgcggtaatacggagggtgcgagcgttaatcggaatcactgggcgtaaagcgtacgtaggtggcaaagtcagtcaggcgtgaaagccctcggctcaaccgaggaattgcgtttgatactactttgctagagtctcggagaggttggcggaattccaggtgtaggagtgaaatccgtagatatctggaggaacaccagtggcgaaggcggccaactggacgagtactgacactgaggtacgaaagcgtgggtagcaaacaggattagataccctggtagtccacgccgtaaacgatggatattaggtgtcgggggtaacccttcggtgccgtagttaacgcgttaaatatcccgcctggggagtacggtcgcaaggctgaaactcaaaggaattgacgggggcccgcacaagcggtggagtatgtggtttaattcgatgcaacgcgaagaaccttacctaggcttgacatcctgagaacctcttttaaacgagagggtgcccttcggggaattcagtgacaggtgctgcatggctgtcgtcagctcgtgccgtgaggtgttgggttaagtcccgcaacgagcgcaacccctattgttagttgccatcacataatggtgggcactctaatgagactgcccgggtcaaccgggaggaaggtggggacgacgtcaagtcatcatggcccttacgcctagggctacacacgtactacaatggtgcatacaaagggcagcgagaccgcgaggtggagctaatcccaaaaaatgcatcccagtccggatcggagtctgcaactcgactccgtgaagttggaatcgctagtaatcccggatcagcatgccggggtgaatacgttcccgggccttgtacacaccgcccgtcacaccacgaaagctggttctacccgataacggcagactaaccctttgggaggtagtcgtctacggtagggctggtaattggggtgaagtcgtaacaaggtagccgtaggggaacctgcggctggatcacctccttta

SEQ ID NO: 6936 - DNA, 1555 bp, Pseudodesulfovibrio sp. S3
  ref <308>: DATABASE ACCESSION NUMBER: NCBI ACCESSION: NZ_QTZO01000038.1
  ref <309>: DATABASE ENTRY DATE: 2019-04-01
  ref <313>: RELEVANT RESIDUES IN SEQ ID NO: (1)..(1555)
aactggagagtttgatcctggctcagattgaacgctggcggcgtgcttaacacatgcaagtcgagcgagaaagctctcttcggagagtgagtagagcggcgcacgggtgagtaacgcgtggataatctgccctgaagatcgggataacagttggaaacgactgctaataccgtataatctacatatttaactttatgtgggaaaggtggcctctatttataagctaccgcttttggatgagtccgcgtctcattagcttgttggtagggtaatggcctaccaaggcaacgatgagtagctggtctgagaggatgatcagccacactgggactgaaacacggcccagactcctacgggaggcagcagtggggaatattgcgcaatgggggaaaccctgacgcagcgacgccgcgtgtaggaagaaggccttcgggtcgtaaactactgtcaagagggaagaaactgttaggcattaatacggcctttcactgacggtacctctagaggaagcaccggctaactccgtgccagcagccgcggtaatacggagggtgcgagcgttaatcggaatcactgggcgtaaagcgtgcgtaggcggcgcaacaagtcaggcgtgaaagccctcggctcaaccgaggaattgcgcttgaaactgttgtgctagagtctcggagaggttggcggaattccaggtgtaggagtgaaatccgtagatatctggaggaacaccggtggcgaaggcggccaactggacgagtactgacgctgaggtacgaaagcgtggggagcaaacaggattagataccctggtagtccacgctgtaaacgatggatattaggtgtcgggttttcaattcggtgccgcagttaacgcgttaaatatcccgcctggggagtacggtcgcaaggctgaaactcaaaggaattgacgggggcccgcacaagcggtggagtatgtggtttaattcgatgcaacgcgaagaaccttacctaggcttgacatcctgagaatctgccttaacaggcggagtgcccttcggggaattcagtgacaggtgctgcatggctgtcgtcagctcgtgccgtgaggtgttgggttaagtcccgcaacgagcgcaacccctattgttagttgccatcacataatggtgggcactctaatgagactgcccgggtcaaccgggaggaaggtggggacgacgtcaagtcatcatggcccttacgcctagggctacacacgtactacaatggtgcatacaaagggttgcgagaccgcgaggttcagccaatcccaaaaaatgcatcccagtccggatcggagtctgcaactcgactccgtgaagttggaatcgctagtaatcccggatcagcatgccggggtgaatacgttcccgggccttgtacacaccgcccgtcacaccacgaaagctggttctacccgacaacggcggactaacccttcgggaggtagtcgtctacggtagggctggtgattggggtgaagtcgtaacaaggtagccgtaggggaacctgcggctggatcacctcctttata

SEQ ID NO: 6937 - DNA, 763 bp, Pseudodonghicola xiamenensis
  ref <308>: DATABASE ACCESSION NUMBER: NCBI ACCESSION: NZ_AUBS01000084.1
  ref <309>: DATABASE ENTRY DATE: 2019-04-01
  ref <313>: RELEVANT RESIDUES IN SEQ ID NO: (1)..(763)
gcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacatccccagagatggggctttcacttcggtgacctagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatcccaaaaagctatctcagttcggattgtcgtctgcaactcggcggcatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 6938 - DNA, 1335 bp, Pseudoflavitalea rhizosphaerae
  ref <308>: DATABASE ACCESSION NUMBER: NCBI ACCESSION: NZ_RCSU01000031.1
  ref <309>: DATABASE ENTRY DATE: 2019-04-01
  ref <313>: RELEVANT RESIDUES IN SEQ ID NO: (1)..(1335)
ttggttattatagctccggcgcttaaagatgggcgtgcgcctgattaggtagttggcggggtaacggcccaccaagccttcgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaacctgtcttttcttgggcagctgacggtaccagatgaataagcaccggctaactccgtgccagcagccgcggtaatacggagggtgcaagcgttatccggattcactgggtttaaagggtgcgtaggtgggacagtaagtcagtggtgaaatctccgggcttaacctggaaactgccgttgatactattgttcttgaatatcgtgtaggtaagcggaatatgtcatgtagcggtgaaatgcttagatatgacatagaacaccaattgcgaaggcagcttactttacgatgattgacactgaggcacgaaagcgtggggagcaaacaggattagataccctggtagtccacgccctaaactatggatactcgacatcagcgatacacagttggtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagtctgaccgtgggtgaaagctcattttgtagcaatacacagattgtaaggtgctgcatggccgtcgtcagctcgtgccgtgaggtgttgggttaagtcccgcaacgagcgcaacccccatcattagttgccatcaggtaaagctgggaactctaatgaaactgccgtcgtaagacgcgaggaaggaggggatgatgtcaggtcatcatggcctttatgcccagggctacacacgtgctacaatgggggagacaaagggctgccacttggcaacaaggcgctaatcccaaaaactccctctcagttcggatcgcagtctgcaactcgactgcgtgaagctggaatcgctagtaatcgtatatcagcaatgatacggtgaatacgttcccggaccttgcacacaccgcccgtcaagccatggaagccgggtgtacctaaagtcggtaaccgcaaggagccgcctagggtaaaactggtgactggggctaagtcgtaacaaggtagccgtatcggaaggtgcggctggaatacctcctttttagag

SEQ ID NO: 6939 - DNA, 1536 bp, Pseudoflavitalea sp. 5GH32-13
  ref <308>: DATABASE ACCESSION NUMBER: NCBI ACCESSION: NZ_CP032157.1
  ref <309>: DATABASE ENTRY DATE: 2019-04-01
  ref <313>: RELEVANT RESIDUES IN SEQ ID NO: (1)..(1536)
tacaatggagagtttgatcctggctcaggatgaacgctagcggcaggcttaatacatgcaagtcgtggggcagcacagtgtagcaatacatgggtggcgaccggcaaacgggtgcggaacacgtacgcaaccttccttcaagtggggaatagcccggggaaacccggattaataccccgtaatactgtgagatggcatcatcttacacttatagctccggcgcttgaagatgggcgtgcgcctgattaggtagttggcggggtaacggcccaccaagccttcgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaacccacggtttctactgtggttgacggtaccagatgaataagcaccggctaactccgtgccagcagccgcggtaatacggagggtgcaagcgttatccggattcactgggtttaaagggtgcgtaggtgggttggtaagtcagtggtgaaatctccgagcttaacttggaaactgccgttgatactatcgatcttgaatatcgcgtaggtaagcggaatatgtcatgtagcggtgaaatgcttagatatgacatagaacaccaattgcgaaggcagcttacttcacgatcattgacactgaggcacgaaagcgtggggagcaaacaggattagataccctggtagtccacgccctaaacgatggatactcgacattagcgatacactgttagtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcggtttgaccgtgggtgaaagctcactttgtagcaatacacagatcgtaaggtgctgcatggccgtcgtcagctcgtgccgtgaggtgttgggttaagtcccgcaacgagcgcaacccccatcattagttgccatcaggtaaagctgggaactctaatgaaactgccgtcgtaagacgcgaggaaggaggggatgatgtcaggtcatcatggcctttatgcccagggctacacacgtgctacaatggagaggacaaagggctgccacttggcgacaaggcgctaatcccaaaaacctcttctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagccgcctagggtaaaactagtgactggggctaagtcgtaacaaggtagccgtatcggaaggtgcggctggaatacctcctttttagag

SEQ ID NO: 6940 - DNA, 1540 bp, Pseudoflavonifractor capillosus
  ref <308>: DATABASE ACCESSION NUMBER: NCBI ACCESSION: NZ_AAXG02000048.1
  ref <309>: DATABASE ENTRY DATE: 2019-04-01
  ref <313>: RELEVANT RESIDUES IN SEQ ID NO: (1)..(1540)
ttttattgagagtttgatcctggctcaggatgaacgctggcggcgtgcttaacacatgcaagtcgaacggagagctcatgacagaggattcgtccaatggattgggtttcttagtggcggacgggtgagtaacgcgtgaggaacctgcctcggagtggggaataacagtccgaaaggactgctaataccgcataatgcagctgagtcgcatgacactggctgccaaagatttatcgctctgagatggcctcgcgtctgattagctagttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggatgaaggctttcgggttgtaaacttcttttatcagggacgaaataaatgacggtacctgatgaataagccacggctaactacgtgccagcagccgcggtaatacgtaggtggcaagcgttatccggatttactgggtgtaaagggcgtgtaggcgggactgcaagtcaggtgtgaaaaccacgggctcaacctgtggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggactgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccgactaacgaagcagagatgcattaggtgcccttcggggaaagtcgagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaagcaatgccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctcctttctaagga

SEQ ID NO: 6941 - DNA, 1539 bp, Pseudoflavonifractor sp. AF19-9AC
  ref <308>: DATABASE ACCESSION NUMBER: NCBI ACCESSION: NZ_QUGI01000006.1
  ref <309>: DATABASE ENTRY DATE: 2019-04-01
  ref <313>: RELEVANT RESIDUES IN SEQ ID NO: (1)..(1539)
tttattgagagtttgatcctggctcaggatgaacgctggcggcgtgcttaacacatgcaagtcgaacggagtgccaatgacagaggattcgtccaatggatttggttacttagtggcggacgggtgagtaacgcgtgaggaacctgccttggagtggggaataacacagtgaaaattgtgctaataccgcataatgcagttgggtcgcatggctctgactgccaaagatttatcgctctgagatggcctcgcgtctgattagctagttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggccctcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgctgtaaacgatggatactaggtgtggggggactgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggtcaacagagggaagcaagaccgcgaggtggagcaaatccctaaaagccatcccagttcggattgcaggctgcaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgttcgagaacgagcggctggatcacctcctttctaagga

SEQ ID NO: 6942 - DNA, 1539 bp, Pseudoflavonifractor sp. Marseille-P3106
  ref <308>: DATABASE ACCESSION NUMBER: NCBI ACCESSION: NZ_LT827109.1
  ref <309>: DATABASE ENTRY DATE: 2019-04-01
  ref <313>: RELEVANT RESIDUES IN SEQ ID NO: (1)..(1539)
ttttattgagagtttgatcctggctcaggatgaacgctggcggcgtgcttaacacatgcaagtcgaacggagagccaatgacggagttttcggacaacggatttggtttcttagtggcggacgggtgagtaacgcgtgagcaacctgccttggagtggggaataacagctggaaacagttgctaataccgcataatgcagcgaggggacatcctcttgctgccaaagatttatcgctctgagatggactcgcgtctgattagctggttggcggggtaacggcccaccaaggcgacgatcagtagccggactgagaggttgaccggccacattgggactgagatacggcccagactcctacgggaggcagcagtggggaatattgggcaatgggcgaaagcctgacccagcaacgccgcgtgaaggaagaaggccctcgggttgtaaacttcttttatcagggacgaaacaaatgacggtacctgatgaataagccacggctaactacgtgccagcagccgcggtaatacgtaggtggcaagcgttatccggatttactgggtgtaaagggcgtgtaggcgggtctgcaagtcaggtgtgaaattccagggctcaaccctggaactgcacttgaaactgtgggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccttattgctagttgctacgcaagagcactctagcgagactgccgttgacaaaacggaggaaggtggggacgacgtcaaatcatcatgccccttatgtcctgggccacacacgtactacaatggcggtcaacagagggaagcaataccgcgaggtggagcgaatccctaaaagccgtcccagttcggattgcaggctgaaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctcctttctaagga

SEQ ID NO: 6943 - DNA, 1568 bp, Pseudogracilibacillus auburnensis
  ref <308>: DATABASE ACCESSION NUMBER: NCBI ACCESSION: NZ_QJJQ01000036.1
  ref <309>: DATABASE ENTRY DATE: 2019-04-01
  ref <313>: RELEVANT RESIDUES IN SEQ ID NO: (1)..(1568)
tttatggagagtttgatcttggctcaggacgaacgctggcggcgtgcctaatacatgcaagtcgagcgcaggaagcagacagattccttcgggatgatgtttgtggaatgagcggcggatgggtgagtaacacgtgggcaacctgcctgtaagcttgggataactccgggaaaccggtgctaataccgaataatgtttttgttcgcatgaacagaaaatgaaaggcggcttttgctgtcacttacagatgggcccgcgtcgcattagctagttggtagggtaatggcttaccaaagcaacgatgcgtagccgacctgagagggtgatcggccacactgggactgagacacggcccagactcctacgggaggcagcagtagggaatcttccgcaatggacgaaagtctgacggagcgacgccgcgtgagtgatgaaggtcttcggatcgtaaaactctgttgttagggaagaacaagtatcgaccgaataagtcggtaccttgacggtacctaaccagaaagccccggctaactacgtgccagcagccgcggtaatacgtagggggcgagcgttgtccggaattattgggcgtaaagggcgcgcaggcggtcttttaagtctgatgtgaaatctcgtagcttaactacgaacggtcattggaaactggaagacttgagtacagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccctttgaccgtcctagagatagggctttcccttcggggacaaaggtgacaggtggtgcatggttgtcgtcagctcgtgtcgtgagatgttgggttaagtcccgtaacgagcgcaacccttaatattagttgccagcattaagttgggcactctaatgtgactgccggtgacaaaccggaggaaggtggggatgacgtcaaatcatcatgccccttatgacctgggctacacacgtgctacaatggatggaacaacgggcagcgaagcggcgacgtggagcgaatcccataaaaccattctcagttcggattgtaggctgcaattcgcctacatgaagcaggaatcgctagtaatcgcggatcagcatgccgcggtgaatacgttcccgggccttgtacacaccgcccgtcacaccacgagagtcggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 6944 - DNA, 1530 bp, Pseudokineococcus lusitanus
  ref <308>: DATABASE ACCESSION NUMBER: NCBI ACCESSION: NZ_RJKN01000015.1
  ref <309>: DATABASE ENTRY DATE: 2019-04-01
  ref <313>: RELEVANT RESIDUES IN SEQ ID NO: (1)..(1530)
ttgatggagagtttgatcctggctcaggacgaacgctggcggcgtgcttaacacatgcaagtcgaacggtgacgacccagcttgctgggtctgatcagtggcgaacgggtgagtaacacgtgagcaacctgccctcgactccgggataaccaccggaaacggtggctaatactggatatgacctcttgccgcatggtggggggtggaaagtttttcggtcggggatgggctcgcggcctatcagcttgttggtggggtgatggcctaccaaggcgacgacgggtagccggcctgagagggtgaccggccacactgggactgagacacggcccagactcctacgggaggcagcagtggggaatattgcgcaatgggcggaagcctgacgcagcgacgccgcgtgagggatgaaggccttcgggttgtaaacctctttcagctccgaagaagcgagagtgacggtaggagcagaagaagcaccggctaactacgtgccagcagccgcggtaatacgtagggtgcaagcgttgtccggaattattgggcgtaaagagctcgtaggcggctcgtcgcgtctgctgtgaaagcccggggcttaaccccgggtctgcagtgggtacgggcgggctagagtgcggtaggggagactggaattcctggtgtagcggtgaaatgcgcagatatcaggaggaacaccggtggcgaaggcgggtctctgggccgtaactgacgctgaggagcgaaagcatgggtagcgaacaggattagataccctggtagtccatgccgtaaacgttgggcgctaggtgtgggccgcattccacgtggtccgtgccgcagctaacgcattaagcgccccgcctggggagtacggccgcaaggctaaaactcaaaggaattgacggggccccgcacaagcggcggagcatgcggattaattcgatgcaacgcgaagaaccttaccaaggcttgacatgcagggaaatcctccagagatggtgggtccgcaagggtcctgcgcaggtggtgcatggttgtcgtcagctcgtgtcgtgagatgttgggttaagtcccgcaacgagcgcaaccctcgttcgatgttgccagcgggtgatgccggggactcatcggagactgccggggtcaactcggaggaaggtggggatgacgtcaaatcatcatgccccttatgtcttgggcttcacgcatgctacaatggccggtacaatgggctgcgagaccgtgaggtggagcgaatcccaaaaagccggtctcagttcggatcggggtctgcaactcgaccccgtgaagtcggagtcgctagtaatcgcagatcagcaacgctgcggtgaatacgttcccggggcttgtacacaccgcccgtcacgtcacgaaagtcggtaacacccgaagccggtggcccaacccgtcagggagggagctgtcgaaggtgggactggcgattgggacgaagtcgtaacaaggtagccgtaccggaaggtgcggctggatcacctcctttctaaggag

SEQ ID NO: 6945 - DNA, 1497 bp, Pseudolabrys sp. Root1462
  misc_feature (1001)..(1001): n is a, c, g, or t
  ref <308>: DATABASE ACCESSION NUMBER: NCBI ACCESSION: NZ_LMFS01000001.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcctaacacatgcaagtcgagcgccgtagcaatacggagcggcagacgggagagtaacacgtgggaacgtgccctttggttcggaataactcagggaaacttgagctaataccggataagcccttcgggggaaagatttattgccattggagcggcccgcgtcggattagctagttggtgaggtaatggctcaccaaggcgacgatccgtagctggtctgagaggatgaccagcctcactgggactgagacacggcccagactcctacgggaggcagcagtggggaatattggacaatgggcgcaagcctgatccagccatgccgcgtggatgatgaaggccctagggttgtaaagtccttttaacggggaagataatgacggtacccgtagaataagccccggctaacttcgtgccagcagccgcggtaatacgaagggggctagcgttgctcggaattactgggcgtaaagcgcacgtaggcggaccgataagtcgggggtgaaatcctggagctcaactccagaactgccttcgaaactgccggtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatgaatgctagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagctcttgacatgtcccgtatgggtttcagagatgagacccttcagttcggctggcgggaacacaggtgctngcatggctgtcgtcagctcgtgtcgtgagatgttgggttaagtcccgcaacgagcgcaaccctcggccttagttgccatcattcagttgggcactctaaggcgactgccggtgataagccggaggaaggtggggatgacgtcaagtcctcatggcccttacgggctgggctacacacgtgctacaatggcggtgacagagggacgcgaaggcgcaagccttggcaaatctcgaaaaaccgtctcagttcggattggggtctgcaactcgaccccatgaagttggaatcgctagtaatcgcggatcagcacgccgcggtgaatacgttcccgggccttgtacacaccgcccgtcacaccatgggagttggttttacctgaagacggtgcgctaacccgcaagggatgcagccggccacggtagggtcagcgactggggtgaagtcgtaacaaggtagccgtaggggaacctgcggctggatcacctcctttctaagg

SEQ ID NO: 6946 - DNA, 1491 bp, Pseudolabrys taiwanensis
  ref <308>: DATABASE ACCESSION NUMBER: NCBI ACCESSION: NZ_CP031417.1
  ref <309>: DATABASE ENTRY DATE: 2019-04-01
  ref <313>: RELEVANT RESIDUES IN SEQ ID NO: (1)..(1491)
tccaacttgagagtttgatcctggctcagagcgaacgctggcggcaggcttaacacatgcaagtcgagcgccccgcaaggggagcggcagacgggagagtaacacgtgggaacgtgcccttcggttcggaataactcagggaaacttgagctaataccggatacgccctaacggggaaagatttattgccgaaggagcggcccgcgtcggattagctagttggtgaggtaatggctcaccaaggcgacgatccgtagctggtctgagaggatggccagcctcactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgctcggaattactgggcgtaaagcgcacgtaggcggtttcttaagtcgggggtgaaatcctggagctcaactccagaactgccttcgatactgggaaacttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatgaatgctagccgttggcgagcttgctcgtcagtggcgcagctaacgctttaagcattccgcctggggagtacggtcgcaagattaaaactcaaaggaattgacgggggcccgcacaagcggtggagcatgtggttcaattcgaagcaacgcgcagaaccttaccagcccttgacatcccggtcgcggagaccagagacggactccttcagttcggctggaccggagacaggtgctgcatggctgtcgtcagctcgtgtcgtgagatgttgggttaagtcccgcaacgagcgcaaccctcgcccttagttgccatcatttagttgggcactctaaggggactgccggtgataagccggaggaaggtggggatgacgtcaagtcctcatggcccttacgggctgggctacacacgtgctacaatggcggtgacagagggatgcaaaggggcgacccttcgcaaatctcaaaaagccgtctcagttcggattggggtctgcaactcgaccccatgaagctggaatcgctagtaatcgcggatcagcacgccgcggtgaatacgttcccgggccttgtacacaccgcccgtcacaccatgggagttggctttacctgaagacggtgcgctaaccgcaaggaggcagccggccacggtagggtcagcgactggggtgaagtcgtaacaaggtagccgtaggggaacctgcggctggatcacctcctttctaag

SEQ ID NO: 6947 - DNA, 1538 bp, Pseudomonadaceae bacterium SI-3
  ref <308>: DATABASE ACCESSION NUMBER: NCBI ACCESSION: NZ_CP026511.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagtggagcttgctccatgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttggatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtaggggaacctgcggctggatcacctccttaa

SEQ ID NO: 6948 - DNA, 818 bp, Pseudomonas abyssi
  ref <308>: DATABASE ACCESSION NUMBER: NCBI ACCESSION: NZ_NTMR01000065.1
  ref <309>: DATABASE ENTRY DATE: 2019-04-01
  ref <313>: RELEVANT RESIDUES IN SEQ ID NO: (1)..(818)
gaaggcgaccacctggactgatactgacgctgaggtgcgaaagcgtggggagcaaacaggattagataccctggtagtccacgccgtaaacgatgtcaactagccgttggaatccttgagattttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccataaaaccgatcgtagtccggattggagtctgcaactcgactccatgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6949 - DNA, 1535 bp, Pseudomonas acidophila
  ref <308>: DATABASE ACCESSION NUMBER: NCBI ACCESSION: NZ_MTZV01000010.1
  ref <309>: DATABASE ENTRY DATE: 2019-04-01
  ref <313>: RELEVANT RESIDUES IN SEQ ID NO: (1)..(1535)
attgaactgaagagtttgatcctggctcagattgaacgctggcggcatgccttacacatgcaagtcgaacggcagcgcgggagcaatcctggcggcgagtggcgaacgggtgagtaatacatcggaacgtgtcctgtagtgggggatagcccggcgaaagccggattaataccgcatacgctctacggaggaaagggggggatcttaggacctctcgctacaggggcggccgatggcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcatcctggttaatacctggggtggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaatcctgctgagaggtgggagtgcccgaaagggagccgtaacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggtcgccaacccgcaagggggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttc

SEQ ID NO: 6950 - DNA, 1537 bp, Pseudomonas aeruginosa
  ref <308>: DATABASE ACCESSION NUMBER: NCBI ACCESSION: NZ_LR134342.1
  ref <309>: DATABASE ENTRY DATE: 2019-04-01
  ref <313>: RELEVANT RESIDUES IN SEQ ID NO: (1)..(1537)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 6951 - DNA, 1537 bp, Pseudomonas aestusnigri
  ref <308>: DATABASE ACCESSION NUMBER: NCBI ACCESSION: NZ_FNVE01000026.1
  ref <309>: DATABASE ENTRY DATE: 2019-04-01
  ref <313>: RELEVANT RESIDUES IN SEQ ID NO: (1)..(1537)
aactgaagagtttgatcatggctcagattgaacgctggcggcaggcctaacacatgcaagtcgagcggatgaagggagcttgctcccggatttagcggcggacgggtgagtaatgcctaggaatctgcctggtagtgggggacaacgactcgaaagggtcgctaataccgcatacgtcctacgggagaaagtgggggatcttcggacctcacgctatcagatgagcctaggtcggattagctagtaggtgaggtaatggctcacctaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagtttaatacgctgcaatcttgacgttaccaacagaataagcaccggctaactctgtgccagcagccgcggtaatacagagggtgcaagcgttaatcggaattactgggcgtaaagcgcgcgtaggcggcttgataagatgggtgtgaaatccccgggcttaacctgggaactgcatccataactgtctggctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtctactagccgttggaatccttgagattttagtggcgcagctaacgcactaagtagaccgcctggggagtacggtcgcaagattaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccataaaaccgatcgtagtccggattggagtctgcaactcgactccatgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6952 - DNA, 1538 bp, Pseudomonas alkylphenolica
  ref <308>: DATABASE ACCESSION NUMBER: NCBI ACCESSION: NZ_QJRG01000049.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttctagagatagattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6953 - DNA, 1540 bp, Pseudomonas amygdali
  ref <308>: DATABASE ACCESSION NUMBER: NCBI ACCESSION: NZ_RBUZ01000081.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6954 - DNA, 1546 bp, Pseudomonas anguilliseptica
  ref <308>: DATABASE ACCESSION NUMBER: NCBI ACCESSION: NZ_FNSC01000001.1
  ref <309>: DATABASE ENTRY DATE: 2019-04-01
  ref <313>: RELEVANT RESIDUES IN SEQ ID NO: (1)..(1546)
gaactgaagagtttgatcatggctcagattgaacgctggcggcaggcctaacacatgcaagtcgagcggtagagagaagcttgcttctcttgagagcggcggacgggtgagtaatgcctgggaatctgccttgtggtgggggataacgttcggaaacggacgctaataccgcatacgtcctacgggagaaagcgggggatcttcggacctcgcgccattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacctaatacgttattgttttgacgttaccggcagaataagcaccggctaacttcgtgccagcagccgcggtaatacgaagggtgcaagcgttaatcggaattactgggcgtaaagcgcgcgtaggtggttcagtaagttggaagtgaaatccccgggctcaacctgggaactgctttcaaaactcctgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggagctcagacacaggtgctgcatggctgtcgtcagctcgtgtcgtgagatgttgggttaagtcccgtaacgagcgcaacccttgtccttagttaccagcacgttatggtgggaactctaaggagactgccggtgacaagccggaggaaggtggggatgacgtcaagtcatcatggccctcacggccagggctacacacgtgctacaatggtcggcacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaatcgaagac

SEQ ID NO: 6955 - DNA, 1540 bp, Pseudomonas avellanae
  ref <308>: DATABASE ACCESSION NUMBER: NCBI ACCESSION: NZ_RBTX01000384.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggaacattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6956 - DNA, 1538 bp, Pseudomonas baetica
  ref <308>: DATABASE ACCESSION NUMBER: NCBI ACCESSION: NZ_PKLC01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6957 - DNA, 1547 bp, Pseudomonas benzenivorans
  ref <308>: DATABASE ACCESSION NUMBER: NCBI ACCESSION: NZ_FNCT01000040.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggatgagggtagcttgctacctgattcagcggcggacgggtgagtaatgcctaggaatctgcctggtagtgggggacaacgtttcgaaaggaacgctaataccgcatacgtcctacgggagaaagtgggggatcttcggacctcacgctatcagatgagcctaggtcggattagctagttggtggggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatctacagaactttccagagatggattggtgccttcgggaactgtaagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgacgaca

SEQ ID NO: 6958 - DNA, 1538 bp, Pseudomonas bohemica
  ref <308>: DATABASE ACCESSION NUMBER: NCBI ACCESSION: NZ_NKHL01000121.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctccctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaggctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccagtgaaccgaccagagatggttgggtgccttcgggaacactgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6959 - DNA, 704 bp, Pseudomonas borbori
  ref <308>: DATABASE ACCESSION NUMBER: NCBI ACCESSION: NZ_FOWX01000078.1
  ref <309>: DATABASE ENTRY DATE: 2019-04-01
  ref <313>: RELEVANT RESIDUES IN SEQ ID NO: (1)..(704)
tttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggagctcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgaagac

SEQ ID NO: 6960 - DNA, 1538 bp, Pseudomonas canadensis
  ref <308>: DATABASE ACCESSION NUMBER: NCBI ACCESSION: NZ_MOAZ01000018.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6961 - DNA, 1540 bp, Pseudomonas caricapapayae
  ref <308>: DATABASE ACCESSION NUMBER: NCBI ACCESSION: NZ_RBVC01000058.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagtacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6962 - DNA, 1540 bp, Pseudomonas cerasi
  ref <308>: DATABASE ACCESSION NUMBER: NCBI ACCESSION: NZ_LT963395.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtgcctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6963 - DNA, 1472 bp, Pseudomonas chengduensis
  ref <308>: DATABASE ACCESSION NUMBER: NCBI ACCESSION: NZ_FMZQ01000035.1
  ref <309>: DATABASE ENTRY DATE: 2019-04-01
  ref <313>: RELEVANT RESIDUES IN SEQ ID NO: (1)..(1472)
ggagcttgctccttgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggagctcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaagaca

SEQ ID NO: 6964 - DNA, 1538 bp, Pseudomonas chlororaphis
  ref <308>: DATABASE ACCESSION NUMBER: NCBI ACCESSION: NZ_LR134334.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6965 - DNA, 1538 bp, Pseudomonas chlororaphis subsp. aurantiaca
gaactgaagagtttgatcatggctcagattgaacgctggcggcaggcctaacacatgcaagtcgagcggtagagaggtgcttgcacctcttgagagcggcggacgggtgagtaaagcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatgggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6966 - DNA, 1540 bp, Pseudomonas coronafaciens
  ref <308>: DATABASE ACCESSION NUMBER: NCBI ACCESSION: NZ_RBVE01000021.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaggctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggttggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6967 - DNA, 1416 bp, Pseudomonas cuatrocienegasensis
  ref <308>: DATABASE ACCESSION NUMBER: NCBI ACCESSION: NZ_FOFP01000050.1
  ref <309>: DATABASE ENTRY DATE: 2019-04-01
  ref <313>: RELEVANT RESIDUES IN SEQ ID NO: (1)..(1416)
agtggtgggggataacgttcggaaacggacgctaataccgcatacgtcctacgggagaaagcgggggaccttcgggcctcgcgccattagatgagcctaggtcggattagctagttggtgaggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtagtaacttaatacgttgctattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaatcgacgaca

SEQ ID NO: 6968 - DNA, 1538 bp, Pseudomonas donghuensis
  ref <308>: DATABASE ACCESSION NUMBER: NCBI ACCESSION: NZ_NWCB01000008.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaayacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggarctctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6969 - DNA, 1541 bp, Pseudomonas entomophila
  ref <308>: DATABASE ACCESSION NUMBER: NCBI ACCESSION: NZ_CP034338.1
  ref <309>: DATABASE ENTRY DATE: 2019-04-01
  ref <313>: RELEVANT RESIDUES IN SEQ ID NO: (1)..(1541)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatatacgtcctacggagaaagcaggggaccttcgggcttgcgctatcagatgagcctaggtcggattagctagttggtgaggtaatggctcaccaaggcgacgatccgtaactggtctgagaggatgatcagtcacactggaactgagacacggtccagactcctacgggaggcagcagtgggaatattggacaatgggcgaaaagcctgatccagccatgccgtgtgtgtgaagaaggtcttcggattgtaaagcactttaagttgggaggaagggcagtaagttaataccttgctgttttgacgttaccgacagaataagcaccggctaactctgtgccagcagccgcggtaatacagaggtgcaagcgttaatcggaattactgggcgtaaaagcgcgcgtaggtggttcgttaagttggatgtgaaagccccgggctcaacctgggaactgcatccaaaactggcgagctagagtatggtagagggtggtggaatttctgtgtgtttgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcatttaagttgaccgcctggggggtacggccgcaaggttaaaactcaaatgaattgacgggggcccgcacaagcggtggagcatgtggtttaattcgaagcaacgcgaagaaccttaccaggccttgaacatgcagagaactttccagagatggattggtgccttcgggaactctgagacaggtgctgcatggctgtcgtcagctcgtgtcgtgagatgttgggttaagtcccgtaacgagcgcaacccttgtccttaagttaccagcacgttatggtggggcactctaaggagactgccggtgacaaaccggaggaagaggtggggagtgacgtcaagtctcatcatggcttacggcctggctacacacgtgctacaatgggtcgggtacagagggttgccaaccgcgaggtggagctaatctcacaaataccgatcgtgagtccggatcgcagtctgcaactcgaccgtggtgaaagtcggaatcgctagtaatcgcaaatcagaatgttgcggtgaatacgttcccgggccttgtacacaccgcccgtcacaccatggggttgcaccagaaagtagctagtctaaccttcgggaggacggttttaccacggtgtgattcattcgggtgaagtcgtaacaaggtagccgtaggggaacctgcggctggatcacctccttaa

SEQ ID NO: 6970 - DNA, 1538 bp, Pseudomonas entomophila
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6971 - DNA, 1538 bp, Pseudomonas entomophila; identical to SEQ ID NO: 6970

SEQ ID NO: 6972 - DNA, 1540 bp, Pseudomonas ficuserectae
  ref <308>: DATABASE ACCESSION NUMBER: NCBI ACCESSION: NZ_RBSO01000010.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6973 - DNA, 1545 bp, Pseudomonas flavescens
  ref <308>: DATABASE ACCESSION NUMBER: NCBI ACCESSION: NZ_FNDG01000047.1
  ref <309>: DATABASE ENTRY DATE: 2019-04-01
  ref <313>: RELEVANT RESIDUES IN SEQ ID NO: (1)..(1545)
gaactgaagagtttgatcatggctcagattgaacgctggcggcaggcctaacacatgcaagtcgagcggttgaggggagcttgctccctgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtggggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgaaga

SEQ ID NO: 6974 - DNA, 1538 bp, Pseudomonas floridensis
  ref <308>: DATABASE ACCESSION NUMBER: NCBI ACCESSION: NZ_MUIO01000051.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgcaagcctgatccagccatgccgcgtgtgtgaagaaggtcttcggattgtaaagcactttaagttgggaggaagggccattacctaatacgtggtggttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaaccttccagagatggaggggtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6975 - DNA, 1539 bp, Pseudomonas fluorescens
  ref <308>: DATABASE ACCESSION NUMBER: NCBI ACCESSION: NZ_LR134318.1
  ref <309>: DATABASE ENTRY DATE: 2019-04-01
  ref <313>: RELEVANT RESIDUES IN SEQ ID NO: (1)..(1539)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtgggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6976 - DNA, 1540 bp, Pseudomonas frederiksbergensis
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6977 - DNA, 1540 bp, Pseudomonas frederiksbergensis; identical to SEQ ID NO: 6976

SEQ ID NO: 6978 - DNA, 1540 bp, Pseudomonas frederiksbergensis; identical to SEQ ID NO: 6976

SEQ ID NO: 6979 - DNA, 1449 bp, Pseudomonas fulva
  ref <308>: DATABASE ACCESSION NUMBER: NCBI ACCESSION: NZ_RHRX01000068.1
  ref <309>: DATABASE ENTRY DATE: 2019-04-01
  ref <313>: RELEVANT RESIDUES IN SEQ ID NO: (1)..(1449)
gattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6980 - DNA, 1547 bp, Pseudomonas furukawaii
  ref <308>: DATABASE ACCESSION NUMBER: NCBI ACCESSION: NZ_AP014862.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggcagcgggtccttcgggatgccggcgagcggcggacgggtgagtaatgcctaggaatctgcctggtagtgggggataactcggggaaactcgagctaataccgcatacgtcctacgggagaaagtgggggatcttcggacctcacgctatcagatgagcctaggtcggattagctagttggtgaggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggaggtgaaatccccgggctcaacctgggaactgcctccaaaactactgggctagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaatcgaagaca

SEQ ID NO: 6981 - DNA, 1539 bp, Pseudomonas gallaeciensis
  ref <308>: DATABASE ACCESSION NUMBER: NCBI ACCESSION: NZ_LMAZ01000018.1
  ref <309>: DATABASE ENTRY DATE: 2019-04-01
  ref <313>: RELEVANT RESIDUES IN SEQ ID NO: (1)..(1539)
aactgaagagtttgatcatggctcagattgaacgctggcggcaggcctaacacatgcaagtcgagcggtagagaaggagcttgcttcttcttgagagcggcggacgggtgagtaatgcctaggaatctgcctggtagtgggggacaacgtttcgaaaggaacgctaataccgcatacgtcctacgggagaaagtgggggatcttcggacctcacgctatcagatgagcctaggtcggattagcttgtaggtgaggtaatggctcacctaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagcttaatacgctgcaaccttgacgttaccaacagaataagcaccggctaactctgtgccagcagccgcggtaatacagagggtgcaagcgttaatcggaattactgggcgtaaagcgcgcgtaggcggcttgataagatgggtgtgaaatccccgggcttaacctgggaactgcatccataactgtctggctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggaatccttgagattttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccataaaaccgatcgtagtccggattggagtctgcaactcgactccatgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6982 - DNA, 994 bp, Pseudomonas gingeri
  ref <308>: DATABASE ACCESSION NUMBER: NCBI ACCESSION: NZ_POWE01000063.1
  ref <309>: DATABASE ENTRY DATE: 2019-04-01
  ref <313>: RELEVANT RESIDUES IN SEQ ID NO: (1)..(994)
gaactgaagagtttgatcatggctcagattgaacgctggcggcaggcctaacacatgcaagtcgagcggatgacgggagcttgcttcctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtagggtagagggtggtggaatttcctgtgtagcggtgaaatgcgtagatataggaaggaacaccagtggcgaaggcgaccacctggactcatactgacactgaggtgcgaaagcgtggggagcaaacaggattagataccctggtagtccacgccgtaaacgatgtcaactagccgttgggaaccttgagttcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatcca

SEQ ID NO: 6983 - DNA, 1546 bp, Pseudomonas guguanensis
  ref <308>: DATABASE ACCESSION NUMBER: NCBI ACCESSION: NZ_FNJJ01000024.1
  ref <309>: DATABASE ENTRY DATE: 2019-04-01
  ref <313>: RELEVANT RESIDUES IN SEQ ID NO: (1)..(1546)
gaactgaagagtttgatcatggctcagattgaacgctggcggcaggcctaacacatgcaagtcgagcggatgaggggagcttgctccctgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggctgctggttaataccctgcagttttgacgttaccaacagaataagcaccggctaacttcgtgccagcagccgcggtaatacgaagggtgcaagcgttaatcggaattactgggcgtaaagcgcgcgtaggtggttttgtaagttggaggtgaaatccccgggctcaacctgggaactgcctccaaaactgcatgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaagaca

SEQ ID NO: 6984 - DNA, 1546 bp, Pseudomonas guineae
  ref <308>: DATABASE ACCESSION NUMBER: NCBI ACCESSION: NZ_FOQL01000010.1
  ref <309>: DATABASE ENTRY DATE: 2019-04-01
  ref <313>: RELEVANT RESIDUES IN SEQ ID NO: (1)..(1546)
gaactgaagagtttgatcatggctcagattgaacgctggcggcaggcctaacacatgcaagtcgagcggtagagagaagcttgcttctcttgagagcggcggacgggtgagtaatgcctaggaatctgcctagtggtgggggataacgttcggaaacggacgctaataccgcatacgtcctacgggagaaagcgggggaccttcgggcctcgcgccattagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtagtaacttaatacgttgctactttgacgttaccgacagaataagcaccggctaacttcgtgccagcagccgcggtaatacgaagggtgcaagcgttaatcggaattactgggcgtaaagcgcgcgtaggtggttcagtaagttgaatgtgaaatccccgggctcaacctgggaactgcatccaaaactgctgaactagagtacggtagagggtagtggaatttcctgtgtagcggtgaaatgcgtagatataggaaggaacaccagtggcgaaggcgactacctggactggtactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgtaatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgaagac

SEQ ID NO: 6985 - DNA, 1378 bp, Pseudomonas indoloxydans
  ref <308>: DATABASE ACCESSION NUMBER: NCBI ACCESSION: NZ_QASO01000077.1
  ref <309>: DATABASE ENTRY DATE: 2019-04-01
  ref <313>: RELEVANT RESIDUES IN SEQ ID NO: (1)..(1378)
cgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 6986 - DNA, 1538 bp, Pseudomonas jessenii
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 6987 - DNA, 1538 bp, Pseudomonas jessenii; identical to SEQ ID NO: 6986

SEQ ID NO: 6988 - DNA, 1538 bp, Pseudomonas kribbensis
  ref <308>: DATABASE ACCESSION NUMBER: NCBI ACCESSION: NZ_CP029608.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6989 - DNA, 1538 bp, Pseudomonas lactis
  ref <308>: DATABASE ACCESSION NUMBER: NCBI ACCESSION: NZ_KZ268915.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6990 - DNA, 1538 bp, Pseudomonas laurylsulfatovorans
  ref <308>: DATABASE ACCESSION NUMBER: NCBI ACCESSION: NZ_MUJK01000025.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6991 - DNA, 1538 bp, Pseudomonas lini; identical to SEQ ID NO: 6965

SEQ ID NO: 6992 - DNA, 1538 bp, Pseudomonas lini; identical to SEQ ID NO: 6965

SEQ ID NO: 6993 - DNA, 1538 bp, Pseudomonas lini
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6994 - DNA, 1538 bp, Pseudomonas lundensis
  ref <308>: DATABASE ACCESSION NUMBER: NCBI ACCESSION: NZ_OBKZ01000023.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatacctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgctttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggaaccttgagttcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccctcgggaggacggttaccacggtgtgattcatgactggggtgaagtcgtaacaaggtagccgtaggggaacctgcggctggatcacctccttaa

SEQ ID NO: 6995 - DNA, 1538 bp, Pseudomonas lurida
  ref <308>: DATABASE ACCESSION NUMBER: NCBI ACCESSION: NZ_PCQP01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6996 - DNA, 1538 bp, Pseudomonas luteola
  ref <308>: DATABASE ACCESSION NUMBER: NCBI ACCESSION: NZ_UAUF01000014.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaggagagcttgctctctgattcagcggcggacgggtgagtaatgcctaggaatctgcctggtagtgggggacaacgtttcgaaaggaacgctaataccgcatacgtcctacgggagaaagtgggggatcttcggacctcacgctatcagatgagcctaggtcggattagctagttggtggggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagctgggaggaagggttgtaacctaatacgttgcaattttgacgttaccagcagaataagcaccggctaactctgtgccagcagccgcggtaatacagagggtgcaagcgttaatcggaattactgggcgtaaagcgcgcgtaggtggcttggtaagttgaatgtgaaatccccgggctcaacctgggaactgcatccaaaactgcctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcaataagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggagaggtgccttcgggaactctgacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggcctgggctacacacgtgctacaatggtcggtacaaagggttgccaaaccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 6997 - DNA, 1431 bp, Pseudomonas marincola
  ref <308>: DATABASE ACCESSION NUMBER: NCBI ACCESSION: NZ_FPBC01000033.1
  ref <309>: DATABASE ENTRY DATE: 2019-04-01
  ref <313>: RELEVANT RESIDUES IN SEQ ID NO: (1)..(1431)
cctaggaatctgcctagtagtgggggataacgttcggaaacgaacgctaataccgcatacgtcctacgggagaaagtgggggaccttcgggcctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggcggtttgttaagttggatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggattccttgagaatttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgttatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaatcgacgaca

SEQ ID NO: 6998 - DNA, 1538 bp, Pseudomonas mendocina
  ref <308>: DATABASE ACCESSION NUMBER: NCBI ACCESSION: NZ_LR134290.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgatttagcggcggacgggtgagtaatgcctaggaatctgcctggtagtgggggataacgttccgaaaggaacgctaataccgcgtacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagagcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 6999 - DNA, 1538 bp, Pseudomonas monteilii
  ref <308>: DATABASE ACCESSION NUMBER: NCBI ACCESSION: NZ_CP022562.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7000 - DNA, 1538 bp, Pseudomonas mosselii
  ref <308>: DATABASE ACCESSION NUMBER: NCBI ACCESSION: NZ_QJRP01000069.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagtaggtgaggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtacgctaataccgtgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7001 - DNA, 1537 bp, Pseudomonas oceani
  ref <308>: DATABASE ACCESSION NUMBER: NCBI ACCESSION: NZ_PPSK01000043.1
  ref <309>: DATABASE ENTRY DATE: 2019-04-01
  ref <313>: RELEVANT RESIDUES IN SEQ ID NO: (1)..(1537)
aactgaagagtttgatcatggctcagattgaacgctggcggcaggcctaacacatgcaagtcgagcggatgaagggagcttgctcctggagttagcggcggacgggtgagtaaagcctaggaatctgcctggtagtgggggacaacgactcgaaagggtcgctaataccgcatacgtcctacgggagaaagtgggggatcttcggacctcacgctatcagatgagcctaggtcggattagcttgtaggtgaggtaatggctcacctaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagtttaatacgctgcaattttgacgttaccaacagaataagcaccggctaactctgtgccagcagccgcggtaatacagagggtgcaagcgttaatcggaattactgggcgtaaagcgcgcgtaggcggcttgataagatgggtgtgaaatccccgggcttaacctgggaactgcatccataactgtctggctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtctactagccgttggaatccttgagattttagtggcgcagctaacgcactaagtagaccgcctggggagtacggtcgcaagattaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccataaaaccgatcgtagtccggattggagtctgcaactcgactccatgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7002 - DNA, 1538 bp, Pseudomonas oleovorans
  ref <308>: DATABASE ACCESSION NUMBER: NCBI ACCESSION: NZ_UGUV01000002.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctccctgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7003 - DNA, 1543 bp, Pseudomonas pachastrellae
  ref <308>: DATABASE ACCESSION NUMBER: NCBI ACCESSION: NZ_FOUD01000055.1
  ref <309>: DATABASE ENTRY DATE: 2019-04-01
  ref <313>: RELEVANT RESIDUES IN SEQ ID NO: (1)..(1543)
aactgaagagtttgatcatggctcagattgaacgctggcggcaggcctaacacatgcaagtcgagcggtagagaaggagcttgcttcttcttgagagcggcggacgggtgagtaatgcctaggaatctgcctggtagtgggggacaacgtttcgaaaggaacgctaataccgcatacgtcctacgggagaaagtgggggatcttcggacctcacgctatcagatgagcctaggtcggattagcttgtaggtgaggtaatggctcacctaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagcttaatacgctgcaactttgacgttaccaacagaataagcaccggctaactctgtgccagcagccgcggtaatacagagggtgcaagcgttaatcggaattactgggcgtaaagcgcgcgtaggcggcttgataagatgggtgtgaaatccccgggcttaacctgggaactgcatccataactgtctggctagagtgcagtagagggtggtggaatttcctgtgtagcggtgaaatgcgtagatataggaaggaacaccagtggcgaaggcgaccacctggactgacactgacgctgaggtgcgaaagcgtggggagcaaacaggattagataccctggtagtccacgccgtaaacgatgtcaactagccgttggaatccttgagattttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccataaaaccgatcgtagtccggattggagtctgcaactcgactccatgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcga

SEQ ID NO: 7004 - DNA, 1538 bp, Pseudomonas parafulva
  ref <308>: DATABASE ACCESSION NUMBER: NCBI ACCESSION: NZ_RCID01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7005 - DNA, 1541 bp, Pseudomonas pelagia
  ref <308>: DATABASE ACCESSION NUMBER: NCBI ACCESSION: NZ_NWMT01000139.1
  ref <309>: DATABASE ENTRY DATE: 2019-04-01
  ref <313>: RELEVANT RESIDUES IN SEQ ID NO: (1)..(1541)
aactgaagagtttgatcatggctcagattgaacgctggcggcaggcctaacacatgcaagtcgagcggtagagagaagcttgcttctcttgagagcggcggacgggtgagtaatacctgggaatctgcctgatagtgggggataacgttcggaaacggacgctaataccgcatacgtcctacgggagaaagcaggggatcttcggaccttgcgctatcagatgagcccaggtcggattagcttgttggtgaggtaacggctcaccaaggcgacgatccgtaactggtctgagaggatgatcagtcacactggaactgagacacggtccagactcctacgggaggcagcagtggggaatattggacaatgggcgcaagcctgatccagccatgccgcgtgtgtgaagaaggtcttcggattgtaaagcactttaagttgggaggaagggttgtagtttaatacgctgcaatcttgacgttaccgacagaataagcaccggctaactctgtgccagcagccgcggtaatacagagggtgcaagcgttaatcggaattactgggcgtaaagcgcgcgtaggtggctaagtaagatgggtgtgaaatccccgggctcaacctgggaactgcatccataactgcttggctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggaaccttgagttcttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggggggtacaaagggttgccaagccgcgaggtggagctaatcccataaaacctctcgtagtccggatcggagtctgcaactcgactccgtgaagtcggaatcgctagtaatcgtggatcagaacgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcga

SEQ ID NO: 7006 - DNA, 965 bp, Pseudomonas peli
  ref <308>: DATABASE ACCESSION NUMBER: NCBI ACCESSION: NZ_FMTL01000016.1
  ref <309>: DATABASE ENTRY DATE: 2019-04-01
  ref <313>: RELEVANT RESIDUES IN SEQ ID NO: (1)..(965)
gttcagtaagttggaagtgaaatccccgggctcaacctgggaactgctttcaaaactgctgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgtaatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaatcgaagac

SEQ ID NO: 7007 - DNA, 1538 bp, Pseudomonas plecoglossicida; identical to SEQ ID NO: 6970
  ref <308>: DATABASE ACCESSION NUMBER: NCBI ACCESSION: NZ_RBLH01000001.1
  ref <309>: DATABASE ENTRY DATE: 2019-04-01
  ref <313>: RELEVANT RESIDUES IN SEQ ID NO: (1)..(1538)

SEQ ID NO: 7008 - DNA, 1540 bp, Pseudomonas protegens
  ref <308>: DATABASE ACCESSION NUMBER: NCBI ACCESSION: NZ_PIZE01000022.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgtccggaaacgggcgctaataccgcatacgtcctacgggagaaagtgggggatcttcggacctcacgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7009 - DNA, 1538 bp, Pseudomonas pseudoalcaligenes; identical to SEQ ID NO: 7002
  ref <308>: DATABASE ACCESSION NUMBER: NCBI ACCESSION: NZ_UGUW01000004.1
  ref <309>: DATABASE ENTRY DATE: 2019-04-01
  ref <313>: RELEVANT RESIDUES IN SEQ ID NO: (1)..(1538)

SEQ ID NO: 7010 - DNA, 1538 bp, Pseudomonas putida; identical to SEQ ID NO: 6970
  ref <308>: DATABASE ACCESSION NUMBER: NCBI ACCESSION: NZ_LR134299.1
  ref <309>: DATABASE ENTRY DATE: 2019-04-01
  ref <313>: RELEVANT RESIDUES IN SEQ ID NO: (1)..(1538)

SEQ ID NO: 7011 - DNA, 1233 bp, Pseudomonas reidholzensis
  ref <308>: DATABASE ACCESSION NUMBER: NCBI ACCESSION: NZ_UNOZ01000002.1
  ref <309>: DATABASE ENTRY DATE: 2019-04-01
  ref <313>: RELEVANT RESIDUES IN SEQ ID NO: (1)..(1233)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttggttaataccttgctgctttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttctagagatagattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctaca

SEQ ID NO: 7012 - DNA, 1538 bp, Pseudomonas resinovorans
  ref <308>: DATABASE ACCESSION NUMBER: NCBI ACCESSION: NZ_BDMA01000120.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggcagcgggtccttcgggatgccggcgagcggcggacgggtgagtaatgcctaggaatctgcctggtagtgggggataacgttcggaaacggacgctaataccgcatacgtcctacgggagaaagtgggggatcttcggacctcacgctatcagatgagcctaggtcggattagctagttggtggggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagctagttaatacctggttgttttgacgttaccaacagaataagcaccggctaacttcgtgccagcagccgcggtaatacgaagggtgcaagcgttaatcggaattactgggcgtaaagcgcgcgtaggtggttcagcaagttggaggtgaaatccccgggctcaacctgggaactgcctccaaaactactgagctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 7013 - DNA, 1541 bp, Pseudomonas sabulinigri
  ref <308>: DATABASE ACCESSION NUMBER: NCBI ACCESSION: NZ_LT629763.1
  ref <309>: DATABASE ENTRY DATE: 2019-04-01
  ref <313>: RELEVANT RESIDUES IN SEQ ID NO: (1)..(1541)
aactgaagagtttgatcatggctcagattgaacgctggcggcaggcctaacacatgcaagtcgagcggtagaaggaagcttgcttcctttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagcttgttggtgaggtaatggctcaccaaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagcctaatacgctgcaactttgacgttaccgacagaataagcaccggctaactctgtgccagcagccgcggtaatacagagggtgcaagcgttaatcggaattactgggcgtaaagcgcgcgtaggtggcaaagtaagatgggtgtgaaatccccgggctcaacctgggaactgcatccataactgcttcgctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttggaatccttgagattttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggggggtacagagggttgccaagccgcgaggtggagctaatcccgaaaagcctctcgtagtccggattggagtctgcaactcgactccatgaagtcggaatcgctagtaatcgcgaatcagaacgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcga

SEQ ID NO: 7014 - DNA, 1542 bp, Pseudomonas salegens
  ref <308>: DATABASE ACCESSION NUMBER: NCBI ACCESSION: NZ_LT629787.1
  ref <309>: DATABASE ENTRY DATE: 2019-04-01
  ref <313>: RELEVANT RESIDUES IN SEQ ID NO: (1)..(1542)
aactgaagagtttgatcatggctcagattgaacgctggcggcaggcctaacacatgcaagtcgagcgattgaagggagcttgctccctgatttagcggcggacgggtgagtaatgcctaggaatctgcctggtagtgggggacaactcggggaaacccgagctaataccgcatacgtcctacgggagaaagtgggggatcttcggacctcacgctatcagatgagcctaggtcggattagcttgttggtgaggtaacggctcaccaaggcagcgatccgtaactggtctgagaggatgatcagtcacactggaactgagacacggtccagactcctacgggaggcagcagtggggaatattggacaatgggggcaaccctgatccagccatgccgcgtgtgtgaagaaggtcttcggattgtaaagcactttaagttgggaggaagggttgtacgttaatagcgtgcaattttgacgttaccaacagaataagcaccggctaactctgtgccagcagccgcggtaatacagagggtgcaagcgttaatcggaattactgggcgtaaagcgcgcgtaggcggtcaagtaagatgggtgtgaaatccccgggctcaacctgggaactgcatccataactgcttgactagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggggaccttgagtctttagtggcgcagctaacgcactaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatgggcggtacagagggttgccaagccgcgaggtggagctaatctctcaaaaccgttcgtagtccggattggagtctgcaactcgactccatgaagtcggaatcgctagtaatcgcgaatcagaatgtcgcggtgaatacgttcccgggccttgtacacaccgcccgtcacaccatgggagtgggttgctccagaagtagctagtctaactttcgagaggacggttaccacggagtgattcatgactggggtgaagtcgtaacaaggtagccgtaggggaacctgcggctggatcacctccttaatcgaa

SEQ ID NO: 7015 - DNA, 1538 bp, Pseudomonas saudiphocaensis
  ref <308>: DATABASE ACCESSION NUMBER: NCBI ACCESSION: NZ_RHQU01000014.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctggatttagcggcggacgggtgagtaatgcctaggaatctgcctggtagtgggggataacgtccggaaacgggcgctaataccgcatacgtcctacgggagaaagcaggggaccttcgggccttgcgctatcagatgagcctaggtcggattagcttgttggtgaggtaacggctcaccaaggctgcgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccaacagaataagcaccggctaacttcgtgccagcagccgcggtaatacgaagggtgcaagcgttaatcggaattactgggcgtaaagcgcgcgtaggtggtttgtcaagttggaagtgaaagccccgggctcaacctgggaactgctttcaaaactggcaagctagagtatggcagagggtggtggaatttcctgtgtagcggtgaaatgcgtagatataggaaggaacatcagtggcgaaggcgaccacctgggctaatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggagctctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtaggggaacctgcggctggatcacctccttaa

SEQ ID NO: 7016 - DNA, 1540 bp, Pseudomonas savastanoi
  ref <308>: DATABASE ACCESSION NUMBER: NCBI ACCESSION: NZ_RBVH01000496.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7017 - DNA, 1551 bp, Pseudomonas segetis
  ref <308>: DATABASE ACCESSION NUMBER: NCBI ACCESSION: NZ_FZOG01000015.1
  ref <309>: DATABASE ENTRY DATE: 2019-04-01
  ref <313>: RELEVANT RESIDUES IN SEQ ID NO: (1)..(1551)
gaactgaagagtttgatcatggctcagattgaacgctggcggcaggcctaacacatgcaagtcgagcggaaacgatgagagcttgctctcaggcgtcgagcggcggacgggtgagtaatgcctaggaatctgcctagtagtgggggataacgttcggaaacggacgctaataccgcatacgtcctacgggagaaagtgggggatcttcggacctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggcggtttgttaagttggatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggattccttgagaatttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgacgaca

SEQ ID NO: 7018 - DNA, 1543 bp, Pseudomonas seleniipraecipitans
  ref <308>: DATABASE ACCESSION NUMBER: NCBI ACCESSION: NZ_FNBM01000016.1
  ref <309>: DATABASE ENTRY DATE: 2019-04-01
  ref <313>: RELEVANT RESIDUES IN SEQ ID NO: (1)..(1543)
gaactgaagagtttgatcatggctcagattgaacgctggcggcaggcctaacacatgcaagtcgagcggttgacgggagcttgctccctgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggaactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgaa

SEQ ID NO: 7019 - DNA, 1547 bp, Pseudomonas sihuiensis
  ref <308>: DATABASE ACCESSION NUMBER: NCBI ACCESSION: NZ_LT629797.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgtccggaaacgggcgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaagaca

SEQ ID NO: 7020 - DNA, 1538 bp, Pseudomonas silesiensis; identical to SEQ ID NO: 6993

SEQ ID NO: 7021 - DNA, 1540 bp, Pseudomonas silesiensis
  ref <308>: DATABASE ACCESSION NUMBER: NCBI ACCESSION: NZ_CP014870.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7022 - DNA, 1538 bp, Pseudomonas silesiensis; identical to SEQ ID NO: 6993

SEQ ID NO: 7023 - DNA, 1538 bp, Pseudomonas silesiensis
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7024 - DNA, 1540 bp, Pseudomonas silesiensis; identical to SEQ ID NO: 6976

SEQ ID NO: 7025 - DNA, 1538 bp, Pseudomonas silesiensis; identical to SEQ ID NO: 7023

SEQ ID NO: 7026 - DNA, 1538 bp, Pseudomonas songnenensis
  ref <308>: DATABASE ACCESSION NUMBER: NCBI ACCESSION: NZ_RWYU02000015.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggagctctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7027 - DNA, 1538 bp, Pseudomonas sp. 02C 26
  ref <308>: DATABASE ACCESSION NUMBER: NCBI ACCESSION: NZ_CP025262.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggtcgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7028 - DNA, 1538 bp, Pseudomonas sp. 09C 129
  ref <308>: DATABASE ACCESSION NUMBER: NCBI ACCESSION: NZ_CP025261.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7029 - DNA, 1114 bp, Pseudomonas sp. 1-7
  ref <308>: DATABASE ACCESSION NUMBER: NCBI ACCESSION: NZ_JPRQ01000048.1
  ref <309>: DATABASE ENTRY DATE: 2019-04-01
  ref <313>: RELEVANT RESIDUES IN SEQ ID NO: (1)..(1114)
aagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7030 - DNA, 1538 bp, Pseudomonas sp. 1033
  ref <308>: DATABASE ACCESSION NUMBER: NCBI ACCESSION: NZ_QUMN01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggtcgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7031 - DNA, 1547 bp, Pseudomonas sp. 2588-5
  ref <308>: DATABASE ACCESSION NUMBER: NCBI ACCESSION: NZ_LJRX01000463.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7032 - DNA, 1547 bp, Pseudomonas sp. 2822-15
  ref <308>: DATABASE ACCESSION NUMBER: NCBI ACCESSION: NZ_LJRY01000105.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagagaagcttgcttctcttgagagcggcggacgggtgagtaaagcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7033 - DNA, 1547 bp, Pseudomonas sp. 2822-17
  ref <308>: DATABASE ACCESSION NUMBER: NCBI ACCESSION: NZ_LJRZ01000335.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7034 - DNA, 1538 bp, Pseudomonas sp. 2848
  ref <308>: DATABASE ACCESSION NUMBER: NCBI ACCESSION: NZ_QKZD01000027.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagtaggtgaggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7035 - DNA, 1538 bp, Pseudomonas sp. 286
  ref <308>: DATABASE ACCESSION NUMBER: NCBI ACCESSION: NZ_UWJC01000047.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacctaatacgttattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7036 - DNA, 1547 bp, Pseudomonas sp. 2995-1
  ref <308>: DATABASE ACCESSION NUMBER: NCBI ACCESSION: NZ_LJSA01000305.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7037 - DNA, 1547 bp, Pseudomonas sp. 2995-3
  ref <308>: DATABASE ACCESSION NUMBER: NCBI ACCESSION: NZ_LJSB01000239.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7038 - DNA, 1540 bp, Pseudomonas sp. 31-12
  ref <308>: DATABASE ACCESSION NUMBER: NCBI ACCESSION: NZ_CP029482.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7039 - DNA, 1538 bp, Pseudomonas sp. 382
  ref <308>: DATABASE ACCESSION NUMBER: NCBI ACCESSION: NZ_PEMX01000072.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaggctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7040 - DNA, 1538 bp, Pseudomonas sp. 424
  ref <308>: DATABASE ACCESSION NUMBER: NCBI ACCESSION: NZ_QRED01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7041 - DNA, 1538 bp, Pseudomonas sp. 43NM1
  ref <308>: DATABASE ACCESSION NUMBER: NCBI ACCESSION: NZ_MKGS01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccctcgggaggacggttaccacggtgtgattcatgactggggtgaagtcgtaacaaggtagccgtaggggaacctgcggctggatcacctccttaa

SEQ ID NO: 7042 - DNA, 1279 bp, Pseudomonas sp. 43mfcvi1.1
  ref <308>: DATABASE ACCESSION NUMBER: NCBI ACCESSION: NZ_UETT01000034.1
  ref <309>: DATABASE ENTRY DATE: 2019-04-01
  ref <313>: RELEVANT RESIDUES IN SEQ ID NO: (1)..(1279)
gctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7043 - DNA, 1016 bp, Pseudomonas sp. 443
  ref <308>: DATABASE ACCESSION NUMBER: NCBI ACCESSION: NZ_QTTH01000050.1
  ref <309>: DATABASE ENTRY DATE: 2019-04-01
  ref <313>: RELEVANT RESIDUES IN SEQ ID NO: (1)..(1016)
cctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtta

SEQ ID NO: 7044 - DNA, 1031 bp, Pseudomonas sp. 478
  ref <308>: DATABASE ACCESSION NUMBER: NCBI ACCESSION: NZ_QKZG01000034.1
  ref <309>: DATABASE ENTRY DATE: 2019-04-01
  ref <313>: RELEVANT RESIDUES IN SEQ ID NO: (1)..(1031)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatctgctagagatagcggagtgccttcggga

SEQ ID NO: 7045 - DNA, 1538 bp, Pseudomonas sp. 57B-090624
  ref <308>: DATABASE ACCESSION NUMBER: NCBI ACCESSION: NZ_QKRU01000146.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagtggagcttgctccatgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcagcaagttggatgtgaaagccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgaagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 7046 - DNA, 1538 bp, Pseudomonas sp. 91RF
  ref <308>: DATABASE ACCESSION NUMBER: NCBI ACCESSION: NZ_QWFC01000037.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcccggatttagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7047 - DNA, 1540 bp, Pseudomonas sp. ACM7; identical to SEQ ID NO: 7038
  ref <308>: DATABASE ACCESSION NUMBER: NCBI ACCESSION: NZ_CP024866.1
  ref <309>: DATABASE ENTRY DATE: 2019-04-01
  ref <313>: RELEVANT RESIDUES IN SEQ ID NO: (1)..(1540)

SEQ ID NO: 7048 - DNA, 1456 bp, Pseudomonas sp. ACN5
  ref <308>: DATABASE ACCESSION NUMBER: NCBI ACCESSION: NZ_MRCP01000038.1
  ref <309>: DATABASE ENTRY DATE: 2019-04-01
  ref <313>: RELEVANT RESIDUES IN SEQ ID NO: (1)..(1456)
attcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatcggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgac

SEQ ID NO: 7049 - DNA, 1546 bp, Pseudomonas sp. ACN8
  ref <308>: DATABASE ACCESSION NUMBER: NCBI ACCESSION: NZ_MRCS01000109.1
  ref <309>: DATABASE ENTRY DATE: 2019-04-01
  ref <313>: RELEVANT RESIDUES IN SEQ ID NO: (1)..(1546)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgac

SEQ ID NO: 7050 - DNA, 1538 bp, Pseudomonas sp. AD21
  ref <308>: DATABASE ACCESSION NUMBER: NCBI ACCESSION: NZ_NQYG01000117.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7051 - DNA, 1538 bp, Pseudomonas sp. AF76
  ref <308>: DATABASE ACCESSION NUMBER: NCBI ACCESSION: NZ_MJML01000011.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7052 - DNA, 1538 bp, Pseudomonas sp. AFG SD02 1510 Pfu 092
  ref <308>: DATABASE ACCESSION NUMBER: NCBI ACCESSION: NZ_PUQD01000125.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7053 - DNA, 1537 bp, Pseudomonas sp. AK6U
  ref <308>: DATABASE ACCESSION NUMBER: NCBI ACCESSION: NZ_CP025229.1
  ref <309>: DATABASE ENTRY DATE: 2019-04-01
  ref <313>: RELEVANT RESIDUES IN SEQ ID NO: (1)..(1537)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 7054 - DNA, 1538 bp, Pseudomonas sp. AOB-7
  ref <308>: DATABASE ACCESSION NUMBER: NCBI ACCESSION: NZ_RFFK01000029.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaggggagcttgctccctgatttagcggcggacgggtgagtaatgcctaggaatctgcctggtggtgggggataacgttccgaaaggaacgctaataccgcatacgtcctacgggagaaagcgggggatcttcggacctcgcgccattagatgagcctaggtcggattagctagttggtgaggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtattcacctaatacgtgagtattttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7055 - DNA, 1538 bp, Pseudomonas sp. AP3 16
  ref <308>: DATABASE ACCESSION NUMBER: NCBI ACCESSION: NZ_NIRS01000004.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7056 - DNA, 1538 bp, Pseudomonas sp. B1 2018
  ref <308>: DATABASE ACCESSION NUMBER: NCBI ACCESSION: NZ_PYUK01000045.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7057 - DNA, 1538 bp, Pseudomonas sp. BBP2017
  ref <308>: DATABASE ACCESSION NUMBER: NCBI ACCESSION: NZ_PVZN01000039.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7058 - DNA, 1538 bp, Pseudomonas sp. BRM28; identical to SEQ ID NO: 7030
  ref <308>: DATABASE ACCESSION NUMBER: NCBI ACCESSION: NZ_PEFV01000001.1
  ref <309>: DATABASE ENTRY DATE: 2019-04-01
  ref <313>: RELEVANT RESIDUES IN SEQ ID NO: (1)..(1538)

SEQ ID NO: 7059 - DNA, 924 bp, Pseudomonas sp. CMAA1215
  ref <308>: DATABASE ACCESSION NUMBER: NCBI ACCESSION: NZ_AVOY01000141.1
  ref <309>: DATABASE ENTRY DATE: 2019-04-01
  ref <313>: RELEVANT RESIDUES IN SEQ ID NO: (1)..(924)
gaactgaagagtttgatcatggctcagattgaacgctggcggcaggcctaacacatgcaagtcgagcggatgaagtgagcttgctcacggatttagcggcggacgggtgagtaatgcctaggaatctgcctggtagtgggggataacgtttcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaatatcttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcattaagttgaccgcctggggagtacggccgcaaggttaaaactcaaatgaattgacgggggc

SEQ ID NO: 7060 - DNA, 1538 bp, Pseudomonas sp. CMR12a
  ref <308>: DATABASE ACCESSION NUMBER: NCBI ACCESSION: NZ_CP027706.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagtgagcttgctcatggattcagcggcggacgggtgagtaatgcctaggaatctgcctggtagtgggggataacgtttcgaaaggagcgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaatatcttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7061 - DNA, 1538 bp, Pseudomonas sp. CMR5c
  ref <308>: DATABASE ACCESSION NUMBER: NCBI ACCESSION: NZ_CP027705.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagtgagcttgctcacggatttagcggcggacgggtgagtaatgcctaggaatctgcctggtagtgggggataacgtttcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaatatcttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7062 - DNA, 1538 bp, Pseudomonas sp. CP019856 s
  ref <308>: DATABASE ACCESSION NUMBER: NCBI ACCESSION: NZ_SGFF01000050.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7063 - DNA, 1538 bp, Pseudomonas sp. C 49-2; identical to SEQ ID NO: 6960
  ref <308>: DATABASE ACCESSION NUMBER: NCBI ACCESSION: NZ_RXYG01000035.1
  ref <309>: DATABASE ENTRY DATE: 2019-04-01
  ref <313>: RELEVANT RESIDUES IN SEQ ID NO: (1)..(1538)

SEQ ID NO: 7064 - DNA, 1538 bp, Pseudomonas sp. Choline-02u-1
  ref <308>: DATABASE ACCESSION NUMBER: NCBI ACCESSION: NZ_PJBC01000022.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7065 - DNA, 1538 bp, Pseudomonas sp. Choline-3u-10
  ref <308>: DATABASE ACCESSION NUMBER: NCBI ACCESSION: NZ_PJBG01000033.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagtggagcttgctccatgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttggatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtaggggaacctgcggctggatcacctccttaa

SEQ ID NO: 7066 - DNA, 1538 bp, Pseudomonas sp. DP16D-E2; identical to SEQ ID NO: 7034
  ref <308>: DATABASE ACCESSION NUMBER: NCBI ACCESSION: NZ_POHX01000086.1
  ref <309>: DATABASE ENTRY DATE: 2019-04-01
  ref <313>: RELEVANT RESIDUES IN SEQ ID NO: (1)..(1538)

SEQ ID NO: 7067 - DNA, 1538 bp, Pseudomonas sp. DP16D-R1
  ref <308>: DATABASE ACCESSION NUMBER: NCBI ACCESSION: NZ_PPSB01000090.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7068 - DNA, 1538 bp, Pseudomonas sp. DSM 29142
  ref <308>: DATABASE ACCESSION NUMBER: NCBI ACCESSION: NZ_JYLP01000052.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7069 - DNA, 936 bp, Pseudomonas sp. DSWY01
  ref <308>: DATABASE ACCESSION NUMBER: NCBI ACCESSION: NZ_RWYR01000143.1
  ref <309>: DATABASE ENTRY DATE: 2019-04-01
  ref <313>: RELEVANT RESIDUES IN SEQ ID NO: (1)..(936)
acggtccagactcctacgggaggcagcagtggggaatattggacaatgggcgaaagcctgatccagccatgccgcgtgtgtgaagaaggtcttcggattgtaaagcactttaagttgggaggaagagcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaag

SEQ ID NO: 7070 - DNA, 1538 bp, Pseudomonas sp. DTU12.3
  ref <308>: DATABASE ACCESSION NUMBER: NCBI ACCESSION: NZ_CP027218.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7071 - DNA, 1538 bp, Pseudomonas sp. DY-1
  ref <308>: DATABASE ACCESSION NUMBER: NCBI ACCESSION: NZ_CP032616.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggcagcgggtccttcgggatgccggcgagcggcggacgggtgagtaatgcctaggaatctgcctggtagtgggggataacgttcggaaacggacgctaataccgcatacgtcctacgggagaaagtgggggatcttcggacctcacgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagctagttaatacctggttgttttgacgttaccaacagaataagcaccggctaacttcgtgccagcagccgcggtaatacgaagggtgcaagcgttaatcggaattactgggcgtaaagcgcgcgtaggtggttcagcaagttggaggtgaaatccccgggctcaacctgggaactgcctccaaaactactgagctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcgactagccgttgggatccttgagatcttagtggcgaagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 7072 - DNA, 1538 bp, Pseudomonas sp. ERMR1 02
  ref <308>: DATABASE ACCESSION NUMBER: NCBI ACCESSION: NZ_NKJI01000005.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaggagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7073 - DNA, 548 bp, Pseudomonas sp. F51
  ref <308>: DATABASE ACCESSION NUMBER: NCBI ACCESSION: NZ_QFFU01000068.1
  ref <309>: DATABASE ENTRY DATE: 2019-04-01
  ref <313>: RELEVANT RESIDUES IN SEQ ID NO: (1)..(548)
cgattttgacgttaccgacagaataagcaccggctaactctgtgccagcagccgcggtaatacagagggtgcaagcgttaatcggaattactgggcgtaaagcgcgcgtaggtggtttgttaagttgaatgtgaaagccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggat

SEQ ID NO: 7074 - DNA, 1538 bp, Pseudomonas sp. FFUP PS 41; identical to SEQ ID NO: 7052
  ref <308>: DATABASE ACCESSION NUMBER: NCBI ACCESSION: NZ_PJQP01000069.1
  ref <309>: DATABASE ENTRY DATE: 2019-04-01
  ref <313>: RELEVANT RESIDUES IN SEQ ID NO: (1)..(1538)

SEQ ID NO: 7075 - DNA, 1538 bp, Pseudomonas sp. FFUP PS 473
  ref <308>: DATABASE ACCESSION NUMBER: NCBI ACCESSION: NZ_PJQQ01000084.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatacctaggaatctgcctgatagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7076 - DNA, 1538 bp, Pseudomonas sp. FW104-15G4B
  ref <308>: DATABASE ACCESSION NUMBER: NCBI ACCESSION: NZ_PPSA01000069.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7077 - DNA, 1538 bp, Pseudomonas sp. FW104-R4
  ref <308>: DATABASE ACCESSION NUMBER: NCBI ACCESSION: NZ_POHP01000110.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaggagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7078 - DNA, 1538 bp, Pseudomonas sp. FW126-L8
  ref <308>: DATABASE ACCESSION NUMBER: NCBI ACCESSION: NZ_POGI01000078.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7079 - DNA, 1538 bp, Pseudomonas sp. FW215-E1
  ref <308>: DATABASE ACCESSION NUMBER: NCBI ACCESSION: NZ_POFQ01000064.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7080 - DNA, 1538 bp, Pseudomonas sp. FW215-L1; identical to SEQ ID NO: 7079
  ref <308>: DATABASE ACCESSION NUMBER: NCBI ACCESSION: NZ_POFN01000060.1
  ref <309>: DATABASE ENTRY DATE: 2019-04-01
  ref <313>: RELEVANT RESIDUES IN SEQ ID NO: (1)..(1538)

SEQ ID NO: 7081 - DNA, 1538 bp, Pseudomonas sp. FW215-L2
  ref <308>: DATABASE ACCESSION NUMBER: NCBI ACCESSION: NZ_PODY01000208.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7082 - DNA, 1538 bp, Pseudomonas sp. FW215-R2; identical to SEQ ID NO: 7079
  ref <308>: DATABASE ACCESSION NUMBER: NCBI ACCESSION: NZ_POFO01000055.1
  ref <309>: DATABASE ENTRY DATE: 2019-04-01
  ref <313>: RELEVANT RESIDUES IN SEQ ID NO: (1)..(1538)

SEQ ID NO: 7083 - DNA, 1538 bp, Pseudomonas sp. FW215-R3
  ref <308>: DATABASE ACCESSION NUMBER: NCBI ACCESSION: NZ_POHS01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7084 - DNA, 1538 bp, Pseudomonas sp. FW215-R4; identical to SEQ ID NO: 7079
  ref <308>: DATABASE ACCESSION NUMBER: NCBI ACCESSION: NZ_POFP01000067.1
  ref <309>: DATABASE ENTRY DATE: 2019-04-01
  ref <313>: RELEVANT RESIDUES IN SEQ ID NO: (1)..(1538)

SEQ ID NO: 7085 - DNA, 1538 bp, Pseudomonas sp. FW215-T2; identical to SEQ ID NO: 7083
  ref <308>: DATABASE ACCESSION NUMBER: NCBI ACCESSION: NZ_POHT01000118.1
  ref <309>: DATABASE ENTRY DATE: 2019-04-01
  ref <313>: RELEVANT RESIDUES IN SEQ ID NO: (1)..(1538)

SEQ ID NO: 7086 - DNA, 1538 bp, Pseudomonas sp. FW300-N1A1
  ref <308>: DATABASE ACCESSION NUMBER: NCBI ACCESSION: NZ_PPSF01000137.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7087 - DNA, 1538 bp, Pseudomonas sp. FW300-N1A5
  ref <308>: DATABASE ACCESSION NUMBER: NCBI ACCESSION: NZ_POHL01000071.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccattacctaatacgtgatggttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7088 - DNA, 1538 bp, Pseudomonas sp. FW301-21B01
  ref <308>: DATABASE ACCESSION NUMBER: NCBI ACCESSION: NZ_POFX01000182.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7089 - DNA, 1540 bp, Pseudomonas sp. FW303-C2
  ref <308>: DATABASE ACCESSION NUMBER: NCBI ACCESSION: NZ_POGN01000088.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7090 - DNA, 1540 bp, Pseudomonas sp. FW305-122
  ref <308>: DATABASE ACCESSION NUMBER: NCBI ACCESSION: NZ_PODM01000096.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7091 - DNA, 1538 bp, Pseudomonas sp. FW305-127; identical to SEQ ID NO: 7034
  ref <308>: DATABASE ACCESSION NUMBER: NCBI ACCESSION: NZ_POIB01000084.1
  ref <309>: DATABASE ENTRY DATE: 2019-04-01
  ref <313>: RELEVANT RESIDUES IN SEQ ID NO: (1)..(1538)

SEQ ID NO: 7092 - DNA, 1538 bp, Pseudomonas sp. FW305-130; identical to SEQ ID NO: 1504
  ref <308>: DATABASE ACCESSION NUMBER: NCBI ACCESSION: NZ_POGR01000149.1
  ref <309>: DATABASE ENTRY DATE: 2019-04-01
  ref <313>: RELEVANT RESIDUES IN SEQ ID NO: (1)..(1538)

SEQ ID NO: 7093 - DNA, 1538 bp, Pseudomonas sp. FW305-131; identical to SEQ ID NO: 7083
  ref <308>: DATABASE ACCESSION NUMBER: NCBI ACCESSION: NZ_POHR01000104.1
  ref <309>: DATABASE ENTRY DATE: 2019-04-01
  ref <313>: RELEVANT RESIDUES IN SEQ ID NO: (1)..(1538)

SEQ ID NO: 7094 - DNA, 1538 bp, Pseudomonas sp. FW305-17; identical to SEQ ID NO: 7034
  ref <308>: DATABASE ACCESSION NUMBER: NCBI ACCESSION: NZ_POIC01000082.1
  ref <309>: DATABASE ENTRY DATE: 2019-04-01
  ref <313>: RELEVANT RESIDUES IN SEQ ID NO: (1)..(1538)

SEQ ID NO: 7095 - DNA, 1540 bp, Pseudomonas sp. FW305-20; identical to SEQ ID NO: 7090
  ref <308>: DATABASE ACCESSION NUMBER: NCBI ACCESSION: NZ_PODL01000081.1
  ref <309>: DATABASE ENTRY DATE: 2019-04-01
  ref <313>: RELEVANT RESIDUES IN SEQ ID NO: (1)..(1540)

SEQ ID NO: 7096 - DNA, 1538 bp, Pseudomonas sp. FW305-25; identical to SEQ ID NO: 7078
  ref <308>: DATABASE ACCESSION NUMBER: NCBI ACCESSION: NZ_POGJ01000078.1
  ref <309>: DATABASE ENTRY DATE: 2019-04-01
  ref <313>: RELEVANT RESIDUES IN SEQ ID NO: (1)..(1538)

SEQ ID NO: 7097 - DNA, 1540 bp, Pseudomonas sp. FW305-3-2-15-A-R2A1; identical to SEQ ID NO: 7021
  ref <308>: DATABASE ACCESSION NUMBER: NCBI ACCESSION: NZ_POFG01000024.1
  ref <309>: DATABASE ENTRY DATE: 2019-04-01
  ref <313>: RELEVANT RESIDUES IN SEQ ID NO: (1)..(1540)

SEQ ID NO: 7098 - DNA, 1538 bp, Pseudomonas sp. FW305-42; identical to SEQ ID NO: 7034
  ref <308>: DATABASE ACCESSION NUMBER: NCBI ACCESSION: NZ_POHY01000111.1
  ref <309>: DATABASE ENTRY DATE: 2019-04-01
  ref <313>: RELEVANT RESIDUES IN SEQ ID NO: (1)..(1538)

SEQ ID NO: 7099 - DNA, 1540 bp, Pseudomonas sp. FW305-47B; identical to SEQ ID NO: 7090
  ref <308>: DATABASE ACCESSION NUMBER: NCBI ACCESSION: NZ_PODJ01000082.1
  ref <309>: DATABASE ENTRY DATE: 2019-04-01
  ref <313>: RELEVANT RESIDUES IN SEQ ID NO: (1)..(1540)

SEQ ID NO: 7100 - DNA, 1540 bp, Pseudomonas sp. FW305-53; identical to SEQ ID NO: 7089
  ref <308>: DATABASE ACCESSION NUMBER: NCBI ACCESSION: NZ_POGL01000106.1
  ref <309>: DATABASE ENTRY DATE: 2019-04-01
  ref <313>: RELEVANT RESIDUES IN SEQ ID NO: (1)..(1540)

SEQ ID NO: 7101 - DNA, 1540 bp, Pseudomonas sp. FW305-62; identical to SEQ ID NO: 7089
  ref <308>: DATABASE ACCESSION NUMBER: NCBI ACCESSION: NZ_POGO01000094.1
  ref <309>: DATABASE ENTRY DATE: 2019-04-01
  ref <313>: RELEVANT RESIDUES IN SEQ ID NO: (1)..(1540)

SEQ ID NO: 7102 - DNA, 1540 bp, Pseudomonas sp. FW305-67; identical to SEQ ID NO: 7089
  ref <308>: DATABASE ACCESSION NUMBER: NCBI ACCESSION: NZ_POGM01000086.1
  ref <309>: DATABASE ENTRY DATE: 2019-04-01
  ref <313>: RELEVANT RESIDUES IN SEQ ID NO: (1)..(1540)

SEQ ID NO: 7103 - DNA, 1538 bp, Pseudomonas sp. FW305-BF15
  ref <308>: DATABASE ACCESSION NUMBER: NCBI ACCESSION: NZ_POHW01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7104 - DNA, 1552 bp, Pseudomonas sp. FW305-BF6
  ref <308>: DATABASE ACCESSION NUMBER: NCBI ACCESSION: NZ_POHU01000055.1
  ref <309>: DATABASE ENTRY DATE: 2019-04-01
  ref <313>: RELEVANT RESIDUES IN SEQ ID NO: (1)..(1552)
attatggagagtttgatcctggctcaggacgaacgctggcggcgtgcctaatacatgcaagtcgagcggacttgtaggagcttgctcctgcaggttagcggcggacgggtgagtaacacgtgggcaacctacctgtaagactgggataacttcgggaaaccggagctaataccggatgacataaaggaactcctgttcctttattgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttct

SEQ ID NO: 7105 - DNA, 1540 bp, Pseudomonas sp. FW305-BF8; identical to SEQ ID NO: 7021
  ref <308>: DATABASE ACCESSION NUMBER: NCBI ACCESSION: NZ_POFB01000096.1
  ref <309>: DATABASE ENTRY DATE: 2019-04-01
  ref <313>: RELEVANT RESIDUES IN SEQ ID NO: (1)..(1540)

SEQ ID NO: 7106 - DNA, 1538 bp, Pseudomonas sp. FW305-E2
  ref <308>: DATABASE ACCESSION NUMBER: NCBI ACCESSION: NZ_PPSJ01000112.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7107 - DNA, 1538 bp, Pseudomonas sp. FW306-02-F02-AA; identical to SEQ ID NO: 7087
  ref <308>: DATABASE ACCESSION NUMBER: NCBI ACCESSION: NZ_POGZ01000078.1
  ref <309>: DATABASE ENTRY DATE: 2019-04-01
  ref <313>: RELEVANT RESIDUES IN SEQ ID NO: (1)..(1538)

SEQ ID NO: 7108 - DNA, 1538 bp, Pseudomonas sp. FW306-02-F02-AB; identical to SEQ ID NO: 7087
  ref <308>: DATABASE ACCESSION NUMBER: NCBI ACCESSION: NZ_POHA01000077.1
  ref <309>: DATABASE ENTRY DATE: 2019-04-01
  ref <313>: RELEVANT RESIDUES IN SEQ ID NO: (1)..(1538)

SEQ ID NO: 7109 - DNA, 1538 bp, Pseudomonas sp. FW306-02-F04-AA; identical to SEQ ID NO: 7087
  ref <308>: DATABASE ACCESSION NUMBER: NCBI ACCESSION: NZ_POHF01000074.1
  ref <309>: DATABASE ENTRY DATE: 2019-04-01
  ref <313>: RELEVANT RESIDUES IN SEQ ID NO: (1)..(1538)

SEQ ID NO: 7110 - DNA, 1538 bp, Pseudomonas sp. FW306-02-F04-BA
  ref <308>: DATABASE ACCESSION NUMBER: NCBI ACCESSION: NZ_POHC01000063.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccattacctaatacgtgatggttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7111 - DNA, 1538 bp, Pseudomonas sp. FW306-02-F08-AA; identical to SEQ ID NO: 7087
  ref <308>: DATABASE ACCESSION NUMBER: NCBI ACCESSION: NZ_POGY01000067.1
  ref <309>: DATABASE ENTRY DATE: 2019-04-01
  ref <313>: RELEVANT RESIDUES IN SEQ ID NO: (1)..(1538)

SEQ ID NO: 7112 - DNA, 1538 bp, Pseudomonas sp. FW306-02-H05-AA; identical to SEQ ID NO: 7087
  ref <308>: DATABASE ACCESSION NUMBER: NCBI ACCESSION: NZ_POHE01000082.1
  ref <309>: DATABASE ENTRY DATE: 2019-04-01
  ref <313>: RELEVANT RESIDUES IN SEQ ID NO: (1)..(1538)

SEQ ID NO: 7113 - DNA, 1538 bp, Pseudomonas sp. FW306-02-H05-AB; identical to SEQ ID NO: 7087
  ref <308>: DATABASE ACCESSION NUMBER: NCBI ACCESSION: NZ_POHN01000074.1
  ref <309>: DATABASE ENTRY DATE: 2019-04-01
  ref <313>: RELEVANT RESIDUES IN SEQ ID NO: (1)..(1538)

SEQ ID NO: 7114 - DNA, 1538 bp, Pseudomonas sp. FW306-02-H05-BA; identical to SEQ ID NO: 7087
  ref <308>: DATABASE ACCESSION NUMBER: NCBI ACCESSION: NZ_POHG01000079.1
  ref <309>: DATABASE ENTRY DATE: 2019-04-01
  ref <313>: RELEVANT RESIDUES IN SEQ ID NO: (1)..(1538)

SEQ ID NO: 7115 - DNA, 1538 bp, Pseudomonas sp. FW306-02-H06B; identical to SEQ ID NO: 7087
  ref <308>: DATABASE ACCESSION NUMBER: NCBI ACCESSION: NZ_POHI01000079.1
  ref <309>: DATABASE ENTRY DATE: 2019-04-01
  ref <313>: RELEVANT RESIDUES IN SEQ ID NO: (1)..(1538)

SEQ ID NO: 7116 - DNA, 1538 bp, Pseudomonas sp. FW306-02-H06C; identical to SEQ ID NO: 7087
  ref <308>: DATABASE ACCESSION NUMBER: NCBI ACCESSION: NZ_POHB01000078.1
  ref <309>: DATABASE ENTRY DATE: 2019-04-01
  ref <313>: RELEVANT RESIDUES IN SEQ ID NO: (1)..(1538)

SEQ ID NO: 7117 - DNA, 1540 bp, Pseudomonas sp. FW306-07-L; identical to SEQ ID NO: 7021
  ref <308>: DATABASE ACCESSION NUMBER: NCBI ACCESSION: NZ_POEX01000082.1
  ref <309>: DATABASE ENTRY DATE: 2019-04-01
  ref <313>: RELEVANT RESIDUES IN SEQ ID NO: (1)..(1540)

SEQ ID NO: 7118 - DNA, 1540 bp, Pseudomonas sp. FW306-1C-G01A; identical to SEQ ID NO: 7021
  ref <308>: DATABASE ACCESSION NUMBER: NCBI ACCESSION: NZ_POFI01000017.1
  ref <309>: DATABASE ENTRY DATE: 2019-04-01
  ref <313>: RELEVANT RESIDUES IN SEQ ID NO: (1)..(1540)

SEQ ID NO: 7119 - DNA, 1538 bp, Pseudomonas sp. FW306-2-11AA; identical to SEQ ID NO: 7087
  ref <308>: DATABASE ACCESSION NUMBER: NCBI ACCESSION: NZ_POHK01000066.1
  ref <309>: DATABASE ENTRY DATE: 2019-04-01
  ref <313>: RELEVANT RESIDUES IN SEQ ID NO: (1)..(1538)

SEQ ID NO: 7120 - DNA, 1538 bp, Pseudomonas sp. FW306-2-11AB; identical to SEQ ID NO: 7087
  ref <308>: DATABASE ACCESSION NUMBER: NCBI ACCESSION: NZ_POHH01000071.1
  ref <309>: DATABASE ENTRY DATE: 2019-04-01
  ref <313>: RELEVANT RESIDUES IN SEQ ID NO: (1)..(1538)

SEQ ID NO: 7121 - DNA, 1538 bp, Pseudomonas sp. FW306-2-11AC; identical to SEQ ID NO: 7087
  ref <308>: DATABASE ACCESSION NUMBER: NCBI ACCESSION: NZ_POHD01000063.1
  ref <309>: DATABASE ENTRY DATE: 2019-04-01
  ref <313>: RELEVANT RESIDUES IN SEQ ID NO: (1)..(1538)

SEQ ID NO: 7122 - DNA, 1538 bp, Pseudomonas sp. FW306-2-11AD; identical to SEQ ID NO: 7087
  ref <308>: DATABASE ACCESSION NUMBER: NCBI ACCESSION: NZ_POHM01000070.1
  ref <309>: DATABASE ENTRY DATE: 2019-04-01
  ref <313>: RELEVANT RESIDUES IN SEQ ID NO: (1)..(1538)

SEQ ID NO: 7123 - DNA, 1538 bp, Pseudomonas sp. FW306-2-11BA; identical to SEQ ID NO: 7087
  ref <308>: DATABASE ACCESSION NUMBER: NCBI ACCESSION: NZ_POHJ01000072.1
  ref <309>: DATABASE ENTRY DATE: 2019-04-01
  ref <313>: RELEVANT RESIDUES IN SEQ ID NO: (1)..(1538)

SEQ ID NO: 7124 - DNA, 1540 bp, Pseudomonas sp. FW306-2-1A-C05A; identical to SEQ ID NO: 7021
  ref <308>: DATABASE ACCESSION NUMBER: NCBI ACCESSION: NZ_POER01000172.1
  ref <309>: DATABASE ENTRY DATE: 2019-04-01
  ref <313>: RELEVANT RESIDUES IN SEQ ID NO: (1)..(1540)

SEQ ID NO: 7125 - DNA, 1540 bp, Pseudomonas sp. FW306-2-2C-A10BC; identical to SEQ ID NO: 7089
  ref <308>: DATABASE ACCESSION NUMBER: NCBI ACCESSION: NZ_POGK01000076.1
  ref <309>: DATABASE ENTRY DATE: 2019-04-01
  ref <313>: RELEVANT RESIDUES IN SEQ ID NO: (1)..(1540)

SEQ ID NO: 7126 - DNA, 1540 bp, Pseudomonas sp. FW306-2-2C-B10A; identical to SEQ ID NO: 7021
  ref <308>: DATABASE ACCESSION NUMBER: NCBI ACCESSION: NZ_POES01000005.1
  ref <309>: DATABASE ENTRY DATE: 2019-04-01
  ref <313>: RELEVANT RESIDUES IN SEQ ID NO: (1)..(1540)

SEQ ID NO: 7127 - DNA, 1538 bp, Pseudomonas sp. FW306-2-2C-D06B; identical to SEQ ID NO: 1504
  ref <308>: DATABASE ACCESSION NUMBER: NCBI ACCESSION: NZ_POGS01000250.1
  ref <309>: DATABASE ENTRY DATE: 2019-04-01
  ref <313>: RELEVANT RESIDUES IN SEQ ID NO: (1)..(1538)

SEQ ID NO: 7128 - DNA, 1538 bp, Pseudomonas sp. FW507-12TSA; identical to SEQ ID NO: 7061
  ref <308>: DATABASE ACCESSION NUMBER: NCBI ACCESSION: NZ_PPSC01000072.1
  ref <309>: DATABASE ENTRY DATE: 2019-04-01
  ref <313>: RELEVANT RESIDUES IN SEQ ID NO: (1)..(1538)

SEQ ID NO: 7129 - DNA, 1540 bp, Pseudomonas sp. FW507-14D01; identical to SEQ ID NO: 7021
  ref <308>: DATABASE ACCESSION NUMBER: NCBI ACCESSION: NZ_POFD01000007.1
  ref <309>: DATABASE ENTRY DATE: 2019-04-01
  ref <313>: RELEVANT RESIDUES IN SEQ ID NO: (1)..(1540)

SEQ ID NO: 7130 - DNA, 1540 bp, Pseudomonas sp. FW507-29LB; identical to SEQ ID NO: 7090
  ref <308>: DATABASE ACCESSION NUMBER: NCBI ACCESSION: NZ_PODI01000083.1
  ref <309>: DATABASE ENTRY DATE: 2019-04-01
  ref <313>: RELEVANT RESIDUES IN SEQ ID NO: (1)..(1540)

SEQ ID NO: 7131 - DNA, 788 bp, Pseudomonas sp. GL14
  ref <308>: DATABASE ACCESSION NUMBER: NCBI ACCESSION: NZ_RFFL01000059.1
  ref <309>: DATABASE ENTRY DATE: 2019-04-01
  ref <313>: RELEVANT RESIDUES IN SEQ ID NO: (1)..(788)
cacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggtttgttaagttggaagtgaaagccccgggctcaacctgggaactgctttcaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggctccttgagagcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccg

SEQ ID NO: 7132 - DNA, 1538 bp, Pseudomonas sp. GL93
  ref <308>: DATABASE ACCESSION NUMBER: NCBI ACCESSION: NZ_NKRF01000102.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7133 - DNA, 1538 bp, Pseudomonas sp. GP01-A1; identical to SEQ ID NO: 7081
  ref <308>: DATABASE ACCESSION NUMBER: NCBI ACCESSION: NZ_PODV01000191.1
  ref <309>: DATABASE ENTRY DATE: 2019-04-01
  ref <313>: RELEVANT RESIDUES IN SEQ ID NO: (1)..(1538)

SEQ ID NO: 7134 - DNA, 1538 bp, Pseudomonas sp. GP01-A11; identical to SEQ ID NO: 7081
  ref <308>: DATABASE ACCESSION NUMBER: NCBI ACCESSION: NZ_PODX01000017.1
  ref <309>: DATABASE ENTRY DATE: 2019-04-01
  ref <313>: RELEVANT RESIDUES IN SEQ ID NO: (1)..(1538)

SEQ ID NO: 7135 - DNA, 1538 bp, Pseudomonas sp. GP01-A13; identical to SEQ ID NO: 7081
  ref <308>: DATABASE ACCESSION NUMBER: NCBI ACCESSION: NZ_PODR01000003.1
  ref <309>: DATABASE ENTRY DATE: 2019-04-01
  ref <313>: RELEVANT RESIDUES IN SEQ ID NO: (1)..(1538)

SEQ ID NO: 7136 - DNA, 1538 bp, Pseudomonas sp. GP01-A14; identical to SEQ ID NO: 7081
  ref <308>: DATABASE ACCESSION NUMBER: NCBI ACCESSION: NZ_PODS01000348.1
  ref <309>: DATABASE ENTRY DATE: 2019-04-01
  ref <313>: RELEVANT RESIDUES IN SEQ ID NO: (1)..(1538)

SEQ ID NO: 7137 - DNA, 1538 bp, Pseudomonas sp. GP01-A15; identical to SEQ ID NO: 7081
  ref <308>: DATABASE ACCESSION NUMBER: NCBI ACCESSION: NZ_PODN01000195.1
  ref <309>: DATABASE ENTRY DATE: 2019-04-01
  ref <313>: RELEVANT RESIDUES IN SEQ ID NO: (1)..(1538)

SEQ ID NO: 7138 - DNA, 1552 bp, Pseudomonas sp. GP01-A3
  ref <308>: DATABASE ACCESSION NUMBER: NCBI ACCESSION: NZ_PODT01000195.1
  ref <309>: DATABASE ENTRY DATE: 2019-04-01
  ref <313>: RELEVANT RESIDUES IN SEQ ID NO: (1)..(1552)
attatggagagtttgatcctggctcaggacgaacgctggcggcgtgcctaatacatgcaagtcgagcggacttgtaggagcttgctcctgcaggttagcggcggacgggtgagtaacacgtgggcaacctacctgtaagactgggataacttcgggaaaccggagctaataccggatgacataaaggaactcctgttcctttattgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttct

SEQ ID NO: 7139 - DNA, 1538 bp, Pseudomonas sp. GP01-A4; identical to SEQ ID NO: 7081
  ref <308>: DATABASE ACCESSION NUMBER: NCBI ACCESSION: NZ_PODW01000162.1
  ref <309>: DATABASE ENTRY DATE: 2019-04-01
  ref <313>: RELEVANT RESIDUES IN SEQ ID NO: (1)..(1538)

SEQ ID NO: 7140 - DNA, 1538 bp, Pseudomonas sp. GP01-A5; identical to SEQ ID NO: 7081
  ref <308>: DATABASE ACCESSION NUMBER: NCBI ACCESSION: NZ_PODO01000006.1
  ref <309>: DATABASE ENTRY DATE: 2019-04-01
  ref <313>: RELEVANT RESIDUES IN SEQ ID NO: (1)..(1538)

SEQ ID NO: 7141 - DNA, 1538 bp, Pseudomonas sp. GP01-A6; identical to SEQ ID NO: 7081
  ref <308>: DATABASE ACCESSION NUMBER: NCBI ACCESSION: NZ_PODU01000175.1
  ref <309>: DATABASE ENTRY DATE: 2019-04-01
  ref <313>: RELEVANT RESIDUES IN SEQ ID NO: (1)..(1538)

SEQ ID NO: 7142 - DNA, 1538 bp, Pseudomonas sp. GP01-A8; identical to SEQ ID NO: 7081
  ref <308>: DATABASE ACCESSION NUMBER: NCBI ACCESSION: NZ_PODQ01000004.1
  ref <309>: DATABASE ENTRY DATE: 2019-04-01
  ref <313>: RELEVANT RESIDUES IN SEQ ID NO: (1)..(1538)

SEQ ID NO: 7143 - DNA, 1538 bp, Pseudomonas sp. GP01-A9; identical to SEQ ID NO: 7081
  ref <308>: DATABASE ACCESSION NUMBER: NCBI ACCESSION: NZ_PODP01000194.1
  ref <309>: DATABASE ENTRY DATE: 2019-04-01
  ref <313>: RELEVANT RESIDUES IN SEQ ID NO: (1)..(1538)

SEQ ID NO: 7144 - DNA, 1538 bp, Pseudomonas sp. GV012
  ref <308>: DATABASE ACCESSION NUMBER: NCBI ACCESSION: NZ_QAXX01000023.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7145 - DNA, 1538 bp, Pseudomonas sp. GV021; identical to SEQ ID NO: 7144
  ref <308>: DATABASE ACCESSION NUMBER: NCBI ACCESSION: NZ_QBKK01000025.1
  ref <309>: DATABASE ENTRY DATE: 2019-04-01
  ref <313>: RELEVANT RESIDUES IN SEQ ID NO: (1)..(1538)

SEQ ID NO: 7146 - DNA, 1538 bp, Pseudomonas sp. GV034
  ref <308>: DATABASE ACCESSION NUMBER: NCBI ACCESSION: NZ_QJSO01000025.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctccttgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttggggtccttgagactttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7147 - DNA, 1538 bp, Pseudomonas sp. GV041
  ref <308>: DATABASE ACCESSION NUMBER: NCBI ACCESSION: NZ_QAXW01000045.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatcggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7148 - DNA, 1538 bp, Pseudomonas sp. GV047
  ref <308>: DATABASE ACCESSION NUMBER: NCBI ACCESSION: NZ_QCWA01000030.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccattacctaatacgtgatggttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatgggtgccttcgggaacattgagacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7149 - DNA, 1538 bp, Pseudomonas sp. GV054; identical to SEQ ID NO: 7146
  ref <308>: DATABASE ACCESSION NUMBER: NCBI ACCESSION: NZ_QAYB01000023.1
  ref <309>: DATABASE ENTRY DATE: 2019-04-01
  ref <313>: RELEVANT RESIDUES IN SEQ ID NO: (1)..(1538)

SEQ ID NO: 7150 - DNA, 1538 bp, Pseudomonas sp. GV058
  ref <308>: DATABASE ACCESSION NUMBER: NCBI ACCESSION: NZ_QJTQ01000028.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7151 - DNA, 1538 bp, Pseudomonas sp. GV062; identical to SEQ ID NO: 7150
  ref <308>: DATABASE ACCESSION NUMBER: NCBI ACCESSION: NZ_QUNM01000029.1
  ref <309>: DATABASE ENTRY DATE: 2019-04-01
  ref <313>: RELEVANT RESIDUES IN SEQ ID NO: (1)..(1538)

SEQ ID NO: 7152 - DNA, 1538 bp, Pseudomonas sp. GV071; identical to SEQ ID NO: 7146
  ref <308>: DATABASE ACCESSION NUMBER: NCBI ACCESSION: NZ_QAOJ01000023.1
  ref <309>: DATABASE ENTRY DATE: 2019-04-01
  ref <313>: RELEVANT RESIDUES IN SEQ ID NO: (1)..(1538)

SEQ ID NO: 7153 - DNA, 1538 bp, Pseudomonas sp. GV082; identical to SEQ ID NO: 7150
  ref <308>: DATABASE ACCESSION NUMBER: NCBI ACCESSION: NZ_QUMY01000029.1
  ref <309>: DATABASE ENTRY DATE: 2019-04-01
  ref <313>: RELEVANT RESIDUES IN SEQ ID NO: (1)..(1538)

SEQ ID NO: 7154 - DNA, 1538 bp, Pseudomonas sp. GV085
  ref <308>: DATABASE ACCESSION NUMBER: NCBI ACCESSION: NZ_QAOV01000037.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatgggtgccttcgggaacattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7155 - DNA, 1538 bp, Pseudomonas sp. GV086; identical to SEQ ID NO: 7150
  ref <308>: DATABASE ACCESSION NUMBER: NCBI ACCESSION: NZ_QUNV01000029.1
  ref <309>: DATABASE ENTRY DATE: 2019-04-01
  ref <313>: RELEVANT RESIDUES IN SEQ ID NO: (1)..(1538)

SEQ ID NO: 7156 - DNA, 1538 bp, Pseudomonas sp. GV088; identical to SEQ ID NO: 7147
  ref <308>: DATABASE ACCESSION NUMBER: NCBI ACCESSION: NZ_QTUI01000044.1
  ref <309>: DATABASE ENTRY DATE: 2019-04-01
  ref <313>: RELEVANT RESIDUES IN SEQ ID NO: (1)..(1538)

SEQ ID NO: 7157 - DNA, 1538 bp, Pseudomonas sp. GV091
  ref <308>: DATABASE ACCESSION NUMBER: NCBI ACCESSION: NZ_QAYF01000039.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacttaatacgttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7158 - DNA, 1538 bp, Pseudomonas sp. GV101; identical to SEQ ID NO: 7150
  ref <308>: DATABASE ACCESSION NUMBER: NCBI ACCESSION: NZ_QUNQ01000031.1
  ref <309>: DATABASE ENTRY DATE: 2019-04-01
  ref <313>: RELEVANT RESIDUES IN SEQ ID NO: (1)..(1538)

SEQ ID NO: 7159 - DNA, 1538 bp, Pseudomonas sp. GV105; identical to SEQ ID NO: 7150
  ref <308>: DATABASE ACCESSION NUMBER: NCBI ACCESSION: NZ_QBUF01000031.1
  ref <309>: DATABASE ENTRY DATE: 2019-04-01
  ref <313>: RELEVANT RESIDUES IN SEQ ID NO: (1)..(1538)

SEQ ID NO: 7160 - DNA, 1540 bp, Pseudomonas sp. GW101-1A09; identical to SEQ ID NO: 7021
  ref <308>: DATABASE ACCESSION NUMBER: NCBI ACCESSION: NZ_POEN01000097.1
  ref <309>: DATABASE ENTRY DATE: 2019-04-01
  ref <313>: RELEVANT RESIDUES IN SEQ ID NO: (1)..(1540)

SEQ ID NO: 7161 - DNA, 1540 bp, Pseudomonas sp. GW101-20A5; identical to SEQ ID NO: 7021
  ref <308>: DATABASE ACCESSION NUMBER: NCBI ACCESSION: NZ_POFE01000126.1
  ref <309>: DATABASE ENTRY DATE: 2019-04-01
  ref <313>: RELEVANT RESIDUES IN SEQ ID NO: (1)..(1540)

SEQ ID NO: 7162 - DNA, 1540 bp, Pseudomonas sp. GW101-3F01; identical to SEQ ID NO: 7021
  ref <308>: DATABASE ACCESSION NUMBER: NCBI ACCESSION: NZ_POFJ01000092.1
  ref <309>: DATABASE ENTRY DATE: 2019-04-01
  ref <313>: RELEVANT RESIDUES IN SEQ ID NO: (1)..(1540)

SEQ ID NO: 7163 - DNA, 1538 bp, Pseudomonas sp. GW247-5R2A; identical to SEQ ID NO: 7078
  ref <308>: DATABASE ACCESSION NUMBER: NCBI ACCESSION: NZ_POGH01000095.1
  ref <309>: DATABASE ENTRY DATE: 2019-04-01
  ref <313>: RELEVANT RESIDUES IN SEQ ID NO: (1)..(1538)

SEQ ID NO: 7164 - DNA, 1538 bp, Pseudomonas sp. GW456-11-11-14-LB1; identical to SEQ ID NO: 7087
  ref <308>: DATABASE ACCESSION NUMBER: NCBI ACCESSION: NZ_POHO01000065.1
  ref <309>: DATABASE ENTRY DATE: 2019-04-01
  ref <313>: RELEVANT RESIDUES IN SEQ ID NO: (1)..(1538)

SEQ ID NO: 7165 - DNA, 1540 bp, Pseudomonas sp. GW456-11-11-14-LB2
  ref <308>: DATABASE ACCESSION NUMBER: NCBI ACCESSION: NZ_POFM01000030.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7166 - DNA, 1540 bp, Pseudomonas sp. GW456-12-1-14-LB2; identical to SEQ ID NO: 7021
  ref <308>: DATABASE ACCESSION NUMBER: NCBI ACCESSION: NZ_POFF01000019.1
  ref <309>: DATABASE ENTRY DATE: 2019-04-01
  ref <313>: RELEVANT RESIDUES IN SEQ ID NO: (1)..(1540)

SEQ ID NO: 7167 - DNA, 1538 bp, Pseudomonas sp. GW456-12-10-14-LB1
  ref <308>: DATABASE ACCESSION NUMBER: NCBI ACCESSION: NZ_PPRX01000097.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7168 - DNA, 1538 bp, Pseudomonas sp. GW456-12-10-14-LB2
  ref <308>: DATABASE ACCESSION NUMBER: NCBI ACCESSION: NZ_POHV01000024.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7169 - DNA, 1538 bp, Pseudomonas sp. GW456-12-10-14-LB3; identical to SEQ ID NO: 7167
  ref <308>: DATABASE ACCESSION NUMBER: NCBI ACCESSION: NZ_PPRW01000096.1
  ref <309>: DATABASE ENTRY DATE: 2019-04-01
  ref <313>: RELEVANT RESIDUES IN SEQ ID NO: (1)..(1538)

SEQ ID NO: 7170 - DNA, 1540 bp, Pseudomonas sp. GW456-A1B; identical to SEQ ID NO: 7090
  ref <308>: DATABASE ACCESSION NUMBER: NCBI ACCESSION: NZ_PODK01000103.1
  ref <309>: DATABASE ENTRY DATE: 2019-04-01
  ref <313>: RELEVANT RESIDUES IN SEQ ID NO: (1)..(1540)

SEQ ID NO: 7171 - DNA, 1540 bp, Pseudomonas sp. GW456-E6; identical to SEQ ID NO: 7021
  ref <308>: DATABASE ACCESSION NUMBER: NCBI ACCESSION: NZ_POEQ01000023.1
  ref <309>: DATABASE ENTRY DATE: 2019-04-01
  ref <313>: RELEVANT RESIDUES IN SEQ ID NO: (1)..(1540)

SEQ ID NO: 7172 - DNA, 1553 bp, Pseudomonas sp. GW456-E7
  ref <308>: DATABASE ACCESSION NUMBER: NCBI ACCESSION: NZ_POHQ01000134.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 7173 - DNA, 1538 bp, Pseudomonas sp. GW456-L12
  ref <308>: DATABASE ACCESSION NUMBER: NCBI ACCESSION: NZ_POGG01000075.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7174 - DNA, 1538 bp, Pseudomonas sp. GW456-L14; identical to SEQ ID NO: 7173
  ref <308>: DATABASE ACCESSION NUMBER: NCBI ACCESSION: NZ_POGF01000085.1
  ref <309>: DATABASE ENTRY DATE: 2019-04-01
  ref <313>: RELEVANT RESIDUES IN SEQ ID NO: (1)..(1538)

SEQ ID NO: 7175 - DNA, 1538 bp, Pseudomonas sp. GW456-R21
  ref <308>: DATABASE ACCESSION NUMBER: NCBI ACCESSION: NZ_PPSE01000079.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccattacctaatacgtgatggttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7176 - DNA, 1540 bp, Pseudomonas sp. GW460-11-11-14-LB11; identical to SEQ ID NO: 7021
  ref <308>: DATABASE ACCESSION NUMBER: NCBI ACCESSION: NZ_POFC01000011.1
  ref <309>: DATABASE ENTRY DATE: 2019-04-01
  ref <313>: RELEVANT RESIDUES IN SEQ ID NO: (1)..(1540)

SEQ ID NO: 7177 - DNA, 1538 bp, Pseudomonas sp. GW460-12; identical to SEQ ID NO: 7088
  ref <308>: DATABASE ACCESSION NUMBER: NCBI ACCESSION: NZ_POFU01000192.1
  ref <309>: DATABASE ENTRY DATE: 2019-04-01
  ref <313>: RELEVANT RESIDUES IN SEQ ID NO: (1)..(1538)

SEQ ID NO: 7178 - DNA, 1540 bp, Pseudomonas sp. GW460-12-1-14-LB3; identical to SEQ ID NO: 7021
  ref <308>: DATABASE ACCESSION NUMBER: NCBI ACCESSION: NZ_POFL01000008.1
  ref <309>: DATABASE ENTRY DATE: 2019-04-01
  ref <313>: RELEVANT RESIDUES IN SEQ ID NO: (1)..(1540)

SEQ ID NO: 7179 - DNA, 1540 bp, Pseudomonas sp. GW460-13; identical to SEQ ID NO: 7021
  ref <308>: DATABASE ACCESSION NUMBER: NCBI ACCESSION: NZ_POEP01000104.1
  ref <309>: DATABASE ENTRY DATE: 2019-04-01
  ref <313>: RELEVANT RESIDUES IN SEQ ID NO: (1)..(1540)

SEQ ID NO: 7180 - DNA, 1538 bp, Pseudomonas sp. GW460-5; identical to SEQ ID NO: 1504
  ref <308>: DATABASE ACCESSION NUMBER: NCBI ACCESSION: NZ_POGQ01000155.1
  ref <309>: DATABASE ENTRY DATE: 2019-04-01
  ref <313>: RELEVANT RESIDUES IN SEQ ID NO: (1)..(1538)

SEQ ID NO: 7181 - DNA, 1540 bp, Pseudomonas sp. GW460-7; identical to SEQ ID NO: 7021
  ref <308>: DATABASE ACCESSION NUMBER: NCBI ACCESSION: NZ_POEY01000107.1
  ref <309>: DATABASE ENTRY DATE: 2019-04-01
  ref <313>: RELEVANT RESIDUES IN SEQ ID NO: (1)..(1540)

SEQ ID NO: 7182 - DNA, 1540 bp, Pseudomonas sp. GW460-8; identical to SEQ ID NO: 7021
  ref <308>: DATABASE ACCESSION NUMBER: NCBI ACCESSION: NZ_POFH01000020.1
  ref <309>: DATABASE ENTRY DATE: 2019-04-01
  ref <313>: RELEVANT RESIDUES IN SEQ ID NO: (1)..(1540)

SEQ ID NO: 7183 - DNA, 1540 bp, Pseudomonas sp. GW460-C2; identical to SEQ ID NO: 7021
  ref <308>: DATABASE ACCESSION NUMBER: NCBI ACCESSION: NZ_POEV01000106.1
  ref <309>: DATABASE ENTRY DATE: 2019-04-01
  ref <313>: RELEVANT RESIDUES IN SEQ ID NO: (1)..(1540)

SEQ ID NO: 7184 - DNA, 1540 bp, Pseudomonas sp. GW460-C3; identical to SEQ ID NO: 7021
  ref <308>: DATABASE ACCESSION NUMBER: NCBI ACCESSION: NZ_POFA01000110.1
  ref <309>: DATABASE ENTRY DATE: 2019-04-01
  ref <313>: RELEVANT RESIDUES IN SEQ ID NO: (1)..(1540)

SEQ ID NO: 7185 - DNA, 1540 bp, Pseudomonas sp. GW460-C8; identical to SEQ ID NO: 7021
  ref <308>: DATABASE ACCESSION NUMBER: NCBI ACCESSION: NZ_POEO01000109.1
  ref <309>: DATABASE ENTRY DATE: 2019-04-01
  ref <313>: RELEVANT RESIDUES IN SEQ ID NO: (1)..(1540)

SEQ ID NO: 7186 - DNA, 1540 bp, Pseudomonas sp. GW460-E13; identical to SEQ ID NO: 7021
  ref <308>: DATABASE ACCESSION NUMBER: NCBI ACCESSION: NZ_POFK01000012.1
  ref <309>: DATABASE ENTRY DATE: 2019-04-01
  ref <313>: RELEVANT RESIDUES IN SEQ ID NO: (1)..(1540)

SEQ ID NO: 7187 - DNA, 1538 bp, Pseudomonas sp. GW460-R15; identical to SEQ ID NO: 7087
  ref <308>: DATABASE ACCESSION NUMBER: NCBI ACCESSION: NZ_PPSH01000087.1
  ref <309>: DATABASE ENTRY DATE: 2019-04-01
  ref <313>: RELEVANT RESIDUES IN SEQ ID NO: (1)..(1538)

SEQ ID NO: 7188 - DNA, 1538 bp, Pseudomonas sp. GW531-E2; identical to SEQ ID NO: 7034
  ref <308>: DATABASE ACCESSION NUMBER: NCBI ACCESSION: NZ_POIA01000075.1
  ref <309>: DATABASE ENTRY DATE: 2019-04-01
  ref <313>: RELEVANT RESIDUES IN SEQ ID NO: (1)..(1538)

SEQ ID NO: 7189 - DNA, 1538 bp, Pseudomonas sp. GW531-R1
  ref <308>: DATABASE ACCESSION NUMBER: NCBI ACCESSION: NZ_PPSG01000071.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccgttacctaatacgtgatggttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7190 - DNA, 1538 bp, Pseudomonas sp. GW531-T4
  ref <308>: DATABASE ACCESSION NUMBER: NCBI ACCESSION: NZ_PPSD01000085.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7191 - DNA, 1538 bp, Pseudomonas sp. GW704-F2; identical to SEQ ID NO: 7150
  ref <308>: DATABASE ACCESSION NUMBER: NCBI ACCESSION: NZ_POEC01000120.1
  ref <309>: DATABASE ENTRY DATE: 2019-04-01
  ref <313>: RELEVANT RESIDUES IN SEQ ID NO: (1)..(1538)

SEQ ID NO: 7192 - DNA, 1538 bp, Pseudomonas sp. GW704-F3; identical to SEQ ID NO: 7150
  ref <308>: DATABASE ACCESSION NUMBER: NCBI ACCESSION: NZ_PODZ01000134.1
  ref <309>: DATABASE ENTRY DATE: 2019-04-01
  ref <313>: RELEVANT RESIDUES IN SEQ ID NO: (1)..(1538)

SEQ ID NO: 7193 - DNA, 1538 bp, Pseudomonas sp. GW704-F5; identical to SEQ ID NO: 7150
  ref <308>: DATABASE ACCESSION NUMBER: NCBI ACCESSION: NZ_POEB01000132.1
  ref <309>: DATABASE ENTRY DATE: 2019-04-01
  ref <313>: RELEVANT RESIDUES IN SEQ ID NO: (1)..(1538)

SEQ ID NO: 7194 - DNA, 1538 bp, Pseudomonas sp. H1h
  ref <308>: DATABASE ACCESSION NUMBER: NCBI ACCESSION: NZ_AYMJ01000035.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7195 - DNA, 1538 bp, Pseudomonas sp. HLS-6
  ref <308>: DATABASE ACCESSION NUMBER: NCBI ACCESSION: NZ_CP024478.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctcctcgattcagcggcggacgggtgagtaatacctaggaatctgcctgatagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7196 - DNA, 1538 bp, Pseudomonas sp. HMWF006
  ref <308>: DATABASE ACCESSION NUMBER: NCBI ACCESSION: NZ_QAIU01000030.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagtgagcttgctcatggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7197 - DNA, 1538 bp, Pseudomonas sp. HMWF021
  ref <308>: DATABASE ACCESSION NUMBER: NCBI ACCESSION: NZ_QAIK01000003.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7198 - DNA, 1638 bp, Pseudomonas sp. ICMP 460
  ref <308>: DATABASE ACCESSION NUMBER: NCBI ACCESSION: NZ_LKBR01000001.1
  ref <309>: DATABASE ENTRY DATE: 2019-04-01
  ref <313>: RELEVANT RESIDUES IN SEQ ID NO: (1)..(1638)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7199 - DNA, 1535 bp, Pseudomonas sp. ICMP 561
  ref <308>: DATABASE ACCESSION NUMBER: NCBI ACCESSION: NZ_LKBT01000036.1
  ref <309>: DATABASE ENTRY DATE: 2019-04-01
  ref <313>: RELEVANT RESIDUES IN SEQ ID NO: (1)..(1535)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgacgac

SEQ ID NO: 7200 - DNA, 1533 bp, Pseudomonas sp. ICMP 564
  misc_feature (73)..(73): n is a, c, g, or t
  ref <308>: DATABASE ACCESSION NUMBER: NCBI ACCESSION: NZ_LKBU01000029.1
  ref <309>: DATABASE ENTRY DATE: 2019-04-01
  ref <313>: RELEVANT RESIDUES IN SEQ ID NO: (1)..(1533)
gaactgaagagtttgatcatggctcagattgaacgctggcggcaggcctaacacatgcaagtcgagcggtagntcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccgttacctaatacgtgatggttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtatgattcatgactggggtgaagtcgtaacaaggtagccgtaggggaacctgcggctggatcacctccttaatcgacgaca

SEQ ID NO: 7201 - DNA, 1538 bp, Pseudomonas sp. JJ3; identical to SEQ ID NO: 7030
  ref <308>: DATABASE ACCESSION NUMBER: NCBI ACCESSION: NZ_PHTD01000020.1
  ref <309>: DATABASE ENTRY DATE: 2019-04-01
  ref <313>: RELEVANT RESIDUES IN SEQ ID NO: (1)..(1538)

SEQ ID NO: 7202 - DNA, 1538 bp, Pseudomonas sp. JS15-10A1
  ref <308>: DATABASE ACCESSION NUMBER: NCBI ACCESSION: NZ_QJSA01000035.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgcaagcctgatccagccatgccgcgtgtgtgaagaaggtcttcggattgtaaagcactttaagttgggaggaagggcagtagattaatactctgctgttttgacgttaccaacagaataagcaccggctaactctgtgccagcagccgcggtaatacagagggtgcaagcgttaatcggaattactgggcgtaaagcgcgcgtaggcggctaggtaagatgggtgtgaaatccccgggctcaacctgggaactgcatccataactgcctggctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggaatccttgagattttagtggcgcagctaacgcactaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatgggcggtacagagggttgccaagccgcgaggtggagctaatcccttaaaaccgttcgtagtccggattggagtctgcaactcgactccatgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7203 - DNA, 1540 bp, Pseudomonas sp. K1S02-6
  ref <308>: DATABASE ACCESSION NUMBER: NCBI ACCESSION: NZ_QYUR01000002.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctagtagtgggggataacgttcggaaacggacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcggtaagttggatgtgaaatccccgggctcaacctgggaactgcatccaaaactgccgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatgtcgagaagtctgcagagatgcggatgtgccttcgggaactcgaacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaa

SEQ ID NO: 7204 - DNA, 1539 bp, Pseudomonas sp. K2W31S-8
  ref <308>: DATABASE ACCESSION NUMBER: NCBI ACCESSION: NZ_CP032419.1
  ref <309>: DATABASE ENTRY DATE: 2019-04-01
  ref <313>: RELEVANT RESIDUES IN SEQ ID NO: (1)..(1539)
gaactgaagagtttgatcatggctcagattgaacgctggcggcaggcctaacacatgcaagtcgagcggcagcgggtccttcgggatgccggcgagcggcggacgggtgagtaatgcctaggaatctgcctgttagtgggggataacgttcgggaaacggacgctaataccgcatacgtcctacgggagaaagtgggggatcttcggacctcacgctaacagatgagcctaggtcggattagctagtaggtgaggtaaaggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaacttcgtgccagcagccgcggtaatacgaagggtgcaagcgttaatcggaattactgggcgtaaagcgcgcgtaggtggtttggtaagttggatgtgaaagccccgggctcaacctgggaactgcatccaaaactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggttccttgagaacttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatctacagaactttccagagatggattggtgccttcgggaactgtaagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccgcaagggggacggttaccacggtgtgattcatgactggggtgaagtcgtaacaaggtagccgtaggggaacctgcggctggatcacctccttaa

SEQ ID NO: 7205 - DNA, 1538 bp, Pseudomonas sp. KBW05
  ref <308>: DATABASE ACCESSION NUMBER: NCBI ACCESSION: NZ_QAJM01000063.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7206 - DNA, 1546 bp, Pseudomonas sp. LAB-08
  ref <308>: DATABASE ACCESSION NUMBER: NCBI ACCESSION: NZ_AP017423.1
  ref <309>: DATABASE ENTRY DATE: 2019-04-01
  ref <313>: RELEVANT RESIDUES IN SEQ ID NO: (1)..(1546)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatcggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgacgac

SEQ ID NO: 7207 - DNA, 1124 bp, Pseudomonas sp. LAMO17WK12 I10
  ref <308>: DATABASE ACCESSION NUMBER: NCBI ACCESSION: NZ_OBDX01000096.1
  ref <309>: DATABASE ENTRY DATE: 2019-04-01
  ref <313>: RELEVANT RESIDUES IN SEQ ID NO: (1)..(1124)
cctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggtt

SEQ ID NO: 7208 - DNA, 1410 bp, Pseudomonas sp. LAMO17WK12 I9
  ref <308>: DATABASE ACCESSION NUMBER: NCBI ACCESSION: NZ_QJKE01000083.1
  ref <309>: DATABASE ENTRY DATE: 2019-04-01
  ref <313>: RELEVANT RESIDUES IN SEQ ID NO: (1)..(1410)
cctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7209 - DNA, 1538 bp, Pseudomonas sp. LB-090624
  ref <308>: DATABASE ACCESSION NUMBER: NCBI ACCESSION: NZ_QJRL01000068.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7210 - DNA, 1538 bp, Pseudomonas sp. LBUM920
  ref <308>: DATABASE ACCESSION NUMBER: NCBI ACCESSION: NZ_CP027762.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7211 - DNA, 1537 bp, Pseudomonas sp. LFM046
  ref <308>: DATABASE ACCESSION NUMBER: NCBI ACCESSION: NZ_JYKO02000001.1
  ref <309>: DATABASE ENTRY DATE: 2019-04-01
  ref <313>: RELEVANT RESIDUES IN SEQ ID NO: (1)..(1537)
gaactgaagagtttgatcatggctcagattgaacgctggcggcaggcctaacacatgcaagtcgagcggcagcgggtccttcgggatgccggcgagcggcggacgggtgagtaatgcctaggaatctgcctggtagtgggggataactcggggaaactcgagctaataccgcatacgtcctacgggagaaagcgggggatcttcggacctcgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaagccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggttccttgagaacttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaaaccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaa

SEQ ID NO: 7212 - DNA, 1538 bp, Pseudomonas sp. LG1D9
  ref <308>: DATABASE ACCESSION NUMBER: NCBI ACCESSION: NZ_CP026881.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7213 - DNA, 1538 bp, Pseudomonas sp. LG1E9
  ref <308>: DATABASE ACCESSION NUMBER: NCBI ACCESSION: NZ_CP029983.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7214 - DNA, 1538 bp, Pseudomonas sp. LH1G9
  ref <308>: DATABASE ACCESSION NUMBER: NCBI ACCESSION: NZ_CP026880.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagagcagttacctaatacgtgattgttttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7215 - DNA, 1538 bp, Pseudomonas sp. LLC-1
  ref <308>: DATABASE ACCESSION NUMBER: NCBI ACCESSION: NZ_LUVY01000032.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7216 - DNA, 814 bp, Pseudomonas sp. LS-2
  ref <308>: DATABASE ACCESSION NUMBER: NCBI ACCESSION: NZ_QXTJ01000032.1
  ref <309>: DATABASE ENTRY DATE: 2019-04-01
  ref <313>: RELEVANT RESIDUES IN SEQ ID NO: (1)..(814)
gcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatgggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7217 - DNA, 1538 bp, Pseudomonas sp. LTGT-11-2Z; identical to SEQ ID NO: 6999
  ref <308>: DATABASE ACCESSION NUMBER: NCBI ACCESSION: NZ_CP033104.1
  ref <309>: DATABASE ENTRY DATE: 2019-04-01
  ref <313>: RELEVANT RESIDUES IN SEQ ID NO: (1)..(1538)

SEQ ID NO: 7218 - DNA, 1538 bp, Pseudomonas sp. LTJR-52
  ref <308>: DATABASE ACCESSION NUMBER: NCBI ACCESSION: NZ_CP033105.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaggagagcttgctctctgattcagcggcggacgggtgagtaatgcctaggaatctgcctggtagtgggggacaacgtttcgaaaggaacgctaataccgcatacgtcctacgggagaaagtgggggatcttcggacctcacgctatcagatgagcctaggtcggattagctagttggtggggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagctgggaggaagggttgtaacctaatacgttgcagctttgacgttaccagcagaataagcaccggctaactctgtgccagcagccgcggtaatacagagggtgcaagcgttaatcggaattactgggcgtaaagcgcgcgtaggtggcttggtaagttgaatgtgaaatccccgggctcaacctgggaactgcatccaaaactgcctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcaataagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggcctgggctacacacgtgctacaatggtcggtacaaagggttgccaaaccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7219 - DNA, 1538 bp, Pseudomonas sp. Larv2 ips; identical to SEQ ID NO: 7210
  ref <308>: DATABASE ACCESSION NUMBER: NCBI ACCESSION: NZ_MEHV01000043.1
  ref <309>: DATABASE ENTRY DATE: 2019-04-01
  ref <313>: RELEVANT RESIDUES IN SEQ ID NO: (1)..(1538)

SEQ ID NO: 7220 - DNA, 1538 bp, Pseudomonas sp. Leaf58
  ref <308>: DATABASE ACCESSION NUMBER: NCBI ACCESSION: NZ_CP032677.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7221 - DNA, 1538 bp, Pseudomonas sp. Leaf98
  ref <308>: DATABASE ACCESSION NUMBER: NCBI ACCESSION: NZ_QFZI01000045.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaaagcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7222 - DNA, 1538 bp, Pseudomonas sp. Lz4W
  ref <308>: DATABASE ACCESSION NUMBER: NCBI ACCESSION: NZ_CP017432.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatacctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgctttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7223 - DNA, 1552 bp, Pseudomonas sp. M30-35
  ref <308>: DATABASE ACCESSION NUMBER: NCBI ACCESSION: NZ_CP020892.1
  ref <309>: DATABASE ENTRY DATE: 2019-04-01
  ref <313>: RELEVANT RESIDUES IN SEQ ID NO: (1)..(1552)
aactgaagagtttgatcatggctcagattgaacgctggcggcaggcctaacacatgcaagtcgagcggtaacaggaggtagcttgctactttgctgacgagcggcggacgggtgagtaatgcctaggaatctgcctagtagtgggggataacgttcggaaacggacgctaataccgcatacgtcctacgggagaaagtgggggatcttcggacctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggcggtttgttaagttgaatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacgctgaggtgcgaaagcgtggggagcaaacaggattagataccctggtagtccacgccgtaaacgatgtcaactagccgttggattccttgagaatttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgtaatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaatcgacgaca

SEQ ID NO: 7224 - DNA, 1538 bp, Pseudomonas sp. MB-090624
  ref <308>: DATABASE ACCESSION NUMBER: NCBI ACCESSION: NZ_QJRK01000094.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7225 - DNA, 1538 bp, Pseudomonas sp. MDMC17
  ref <308>: DATABASE ACCESSION NUMBER: NCBI ACCESSION: NZ_QLYW01000046.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7226 - DNA, 1538 bp, Pseudomonas sp. MDMC216; identical to SEQ ID NO: 7225
  ref <308>: DATABASE ACCESSION NUMBER: NCBI ACCESSION: NZ_QLYV01000062.1
  ref <309>: DATABASE ENTRY DATE: 2019-04-01
  ref <313>: RELEVANT RESIDUES IN SEQ ID NO: (1)..(1538)

SEQ ID NO: 7227 - DNA, 1538 bp, Pseudomonas sp. MDMC224; identical to SEQ ID NO: 7225
  ref <308>: DATABASE ACCESSION NUMBER: NCBI ACCESSION: NZ_QLYU01000037.1
  ref <309>: DATABASE ENTRY DATE: 2019-04-01
  ref <313>: RELEVANT RESIDUES IN SEQ ID NO: (1)..(1538)

SEQ ID NO: 7228 - DNA, 1540 bp, Pseudomonas sp. MF4836
  ref <308>: DATABASE ACCESSION NUMBER: NCBI ACCESSION: NZ_MVOL01000034.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7229 - DNA, 1538 bp, Pseudomonas sp. MF6396; identical to SEQ ID NO: 7030
  ref <308>: DATABASE ACCESSION NUMBER: NCBI ACCESSION: NZ_MVOK01000061.1
  ref <309>: DATABASE ENTRY DATE: 2019-04-01
  ref <313>: RELEVANT RESIDUES IN SEQ ID NO: (1)..(1538)

SEQ ID NO: 7230 - DNA, 1538 bp, Pseudomonas sp. MPBC4-3; identical to SEQ ID NO: 7088
  ref <308>: DATABASE ACCESSION NUMBER: NCBI ACCESSION: NZ_POFS01000195.1
  ref <309>: DATABASE ENTRY DATE: 2019-04-01
  ref <313>: RELEVANT RESIDUES IN SEQ ID NO: (1)..(1538)

SEQ ID NO: 7231 - DNA, 1538 bp, Pseudomonas sp. MPBD4-3; identical to SEQ ID NO: 7150
  ref <308>: DATABASE ACCESSION NUMBER: NCBI ACCESSION: NZ_POEA01000168.1
  ref <309>: DATABASE ENTRY DATE: 2019-04-01
  ref <313>: RELEVANT RESIDUES IN SEQ ID NO: (1)..(1538)

SEQ ID NO: 7232 - DNA, 1538 bp, Pseudomonas sp. MPBD7-1
  ref <308>: DATABASE ACCESSION NUMBER: NCBI ACCESSION: NZ_PPRZ01000317.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7233 - DNA, 1538 bp, Pseudomonas sp. MPR-ANB1; identical to SEQ ID NO: 7088
  ref <308>: DATABASE ACCESSION NUMBER: NCBI ACCESSION: NZ_POGB01000173.1
  ref <309>: DATABASE ENTRY DATE: 2019-04-01
  ref <313>: RELEVANT RESIDUES IN SEQ ID NO: (1)..(1538)

SEQ ID NO: 7234 - DNA, 1538 bp, Pseudomonas sp. MPR-ANC1
  ref <308>: DATABASE ACCESSION NUMBER: NCBI ACCESSION: NZ_PPRY01000084.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7235 - DNA, 1540 bp, Pseudomonas sp. MPR-AND1A; identical to SEQ ID NO: 7021
  ref <308>: DATABASE ACCESSION NUMBER: NCBI ACCESSION: NZ_POEZ01000022.1
  ref <309>: DATABASE ENTRY DATE: 2019-04-01
  ref <313>: RELEVANT RESIDUES IN SEQ ID NO: (1)..(1540)

SEQ ID NO: 7236 - DNA, 1540 bp, Pseudomonas sp. MPR-E5; identical to SEQ ID NO: 7021
  ref <308>: DATABASE ACCESSION NUMBER: NCBI ACCESSION: NZ_POEU01000016.1
  ref <309>: DATABASE ENTRY DATE: 2019-04-01
  ref <313>: RELEVANT RESIDUES IN SEQ ID NO: (1)..(1540)

SEQ ID NO: 7237 - DNA, 1538 bp, Pseudomonas sp. MPR-LB3; identical to SEQ ID NO: 7088
  ref <308>: DATABASE ACCESSION NUMBER: NCBI ACCESSION: NZ_POFY01000166.1
  ref <309>: DATABASE ENTRY DATE: 2019-04-01
  ref <313>: RELEVANT RESIDUES IN SEQ ID NO: (1)..(1538)

SEQ ID NO: 7238 - DNA, 1538 bp, Pseudomonas sp. MPR-LB5; identical to SEQ ID NO: 7088
  ref <308>: DATABASE ACCESSION NUMBER: NCBI ACCESSION: NZ_POGC01000162.1
  ref <309>: DATABASE ENTRY DATE: 2019-04-01
  ref <313>: RELEVANT RESIDUES IN SEQ ID NO: (1)..(1538)

SEQ ID NO: 7239 - DNA, 1538 bp, Pseudomonas sp. MPR-R1B; identical to SEQ ID NO: 7034
  ref <308>: DATABASE ACCESSION NUMBER: NCBI ACCESSION: NZ_POHZ01000077.1
  ref <309>: DATABASE ENTRY DATE: 2019-04-01
  ref <313>: RELEVANT RESIDUES IN SEQ ID NO: (1)..(1538)

SEQ ID NO: 7240 - DNA, 1540 bp, Pseudomonas sp. MPR-R2A2; identical to SEQ ID NO: 7021
  ref <308>: DATABASE ACCESSION NUMBER: NCBI ACCESSION: NZ_POEW01000006.1
  ref <309>: DATABASE ENTRY DATE: 2019-04-01
  ref <313>: RELEVANT RESIDUES IN SEQ ID NO: (1)..(1540)

SEQ ID NO: 7241 - DNA, 1538 bp, Pseudomonas sp. MPR-R2A3; identical to SEQ ID NO: 7088
  ref <308>: DATABASE ACCESSION NUMBER: NCBI ACCESSION: NZ_POFW01000153.1
  ref <309>: DATABASE ENTRY DATE: 2019-04-01
  ref <313>: RELEVANT RESIDUES IN SEQ ID NO: (1)..(1538)

SEQ ID NO: 7242 - DNA, 1538 bp, Pseudomonas sp. MPR-R2A4; identical to SEQ ID NO: 7088
  ref <308>: DATABASE ACCESSION NUMBER: NCBI ACCESSION: NZ_POFT01000156.1
  ref <309>: DATABASE ENTRY DATE: 2019-04-01
  ref <313>: RELEVANT RESIDUES IN SEQ ID NO: (1)..(1538)

SEQ ID NO: 7243 - DNA, 1538 bp, Pseudomonas sp. MPR-R2A5; identical to SEQ ID NO: 7088
  ref <308>: DATABASE ACCESSION NUMBER: NCBI ACCESSION: NZ_POFV01000175.1
  ref <309>: DATABASE ENTRY DATE: 2019-04-01
  ref <313>: RELEVANT RESIDUES IN SEQ ID NO: (1)..(1538)

SEQ ID NO: 7244 - DNA, 1538 bp, Pseudomonas sp. MPR-R2A6; identical to SEQ ID NO: 7088
  ref <308>: DATABASE ACCESSION NUMBER: NCBI ACCESSION: NZ_POGA01000164.1
  ref <309>: DATABASE ENTRY DATE: 2019-04-01
  ref <313>: RELEVANT RESIDUES IN SEQ ID NO: (1)..(1538)

SEQ ID NO: 7245 - DNA, 1538 bp, Pseudomonas sp. MPR-R2A7; identical to SEQ ID NO: 7088
  ref <308>: DATABASE ACCESSION NUMBER: NCBI ACCESSION: NZ_POFR01000184.1
  ref <309>: DATABASE ENTRY DATE: 2019-04-01
  ref <313>: RELEVANT RESIDUES IN SEQ ID NO: (1)..(1538)

SEQ ID NO: 7246 - DNA, 1540 bp, Pseudomonas sp. MPR-R3B; identical to SEQ ID NO: 7089
  ref <308>: DATABASE ACCESSION NUMBER: NCBI ACCESSION: NZ_POGP01000084.1
  ref <309>: DATABASE ENTRY DATE: 2019-04-01
  ref <313>: RELEVANT RESIDUES IN SEQ ID NO: (1)..(1540)

SEQ ID NO: 7247 - DNA, 1538 bp, Pseudomonas sp. MPR-R5A; identical to SEQ ID NO: 7088
  ref <308>: DATABASE ACCESSION NUMBER: NCBI ACCESSION: NZ_POFZ01000203.1
  ref <309>: DATABASE ENTRY DATE: 2019-04-01
  ref <313>: RELEVANT RESIDUES IN SEQ ID NO: (1)..(1538)

SEQ ID NO: 7248 - DNA, 1538 bp, Pseudomonas sp. MPR-R5B; identical to SEQ ID NO: 7088
  ref <308>: DATABASE ACCESSION NUMBER: NCBI ACCESSION: NZ_POGD01000192.1
  ref <309>: DATABASE ENTRY DATE: 2019-04-01
  ref <313>: RELEVANT RESIDUES IN SEQ ID NO: (1)..(1538)

SEQ ID NO: 7249 - DNA, 1540 bp, Pseudomonas sp. MPR-TSA4; identical to SEQ ID NO: 7021
  ref <308>: DATABASE ACCESSION NUMBER: NCBI ACCESSION: NZ_POET01000099.1
  ref <309>: DATABASE ENTRY DATE: 2019-04-01
  ref <313>: RELEVANT RESIDUES IN SEQ ID NO: (1)..(1540)

SEQ ID NO: 7250 - DNA, 1538 bp, Pseudomonas sp. MR 02; identical to SEQ ID NO: 7052
  ref <308>: DATABASE ACCESSION NUMBER: NCBI ACCESSION: NZ_PESJ01000061.1
  ref <309>: DATABASE ENTRY DATE: 2019-04-01
  ref <313>: RELEVANT RESIDUES IN SEQ ID NO: (1)..(1538)

SEQ ID NO: 7251 - DNA, 1538 bp, Pseudomonas sp. MWU12-2115
  ref <308>: DATABASE ACCESSION NUMBER: NCBI ACCESSION: NZ_PPXZ02000037.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7252 - DNA, 1540 bp, Pseudomonas sp. MWU12-2534b
  ref <308>: DATABASE ACCESSION NUMBER: NCBI ACCESSION: NZ_PQCH02000021.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgtccggaaacgggcgctaataccgcatacgtcctacgggagaaagtgggggatcttcggacctcacgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7253 - DNA, 1538 bp, Pseudomonas sp. MYb115
  ref <308>: DATABASE ACCESSION NUMBER: NCBI ACCESSION: NZ_PCQM01000062.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7254 - DNA, 1538 bp, Pseudomonas sp. MYb13; identical to SEQ ID NO: 6995
  ref <308>: DATABASE ACCESSION NUMBER: NCBI ACCESSION: NZ_PCQI01000037.1
  ref <309>: DATABASE ENTRY DATE: 2019-04-01
  ref <313>: RELEVANT RESIDUES IN SEQ ID NO: (1)..(1538)

SEQ ID NO: 7255 - DNA, 1538 bp, Pseudomonas sp. MYb187
  ref <308>: DATABASE ACCESSION NUMBER: NCBI ACCESSION: NZ_PCOA01000035.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgccctacgggggaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggtcgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7256 - DNA, 1538 bp, Pseudomonas sp. MYb2
  ref <308>: DATABASE ACCESSION NUMBER: NCBI ACCESSION: NZ_PCQC01000003.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7257 - DNA, 1538 bp, Pseudomonas sp. MYb3; identical to SEQ ID NO: 7256
  ref <308>: DATABASE ACCESSION NUMBER: NCBI ACCESSION: NZ_PCPN01000035.1
  ref <309>: DATABASE ENTRY DATE: 2019-04-01
  ref <313>: RELEVANT RESIDUES IN SEQ ID NO: (1)..(1538)

SEQ ID NO: 7258 - DNA, 1538 bp, Pseudomonas sp. MYb60
  ref <308>: DATABASE ACCESSION NUMBER: NCBI ACCESSION: NZ_PCOZ01000039.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7259 - DNA, 1538 bp, Pseudomonas sp. NC02
  ref <308>: DATABASE ACCESSION NUMBER: NCBI ACCESSION: NZ_CP025624.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggggaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7260 - DNA, 1538 bp, Pseudomonas sp. NDM
  ref <308>: DATABASE ACCESSION NUMBER: NCBI ACCESSION: NZ_QETJ01000305.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaaaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7261 - DNA, 1538 bp, Pseudomonas sp. NFACC11-2
  ref <308>: DATABASE ACCESSION NUMBER: NCBI ACCESSION: NZ_PVZA01000032.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7262 - DNA, 1451 bp, Pseudomonas sp. NFACC36
  ref <308>: DATABASE ACCESSION NUMBER: NCBI ACCESSION: NZ_FPKB01000045.1
  ref <309>: DATABASE ENTRY DATE: 2019-04-01
  ref <313>: RELEVANT RESIDUES IN SEQ ID NO: (1)..(1451)
tcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7263 - DNA, 1538 bp, Pseudomonas sp. NFACC50-1
  ref <308>: DATABASE ACCESSION NUMBER: NCBI ACCESSION: NZ_PVUC01000035.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7264 - DNA, 1540 bp, Pseudomonas sp. NFPP22
  ref <308>: DATABASE ACCESSION NUMBER: NCBI ACCESSION: NZ_PVUD01000014.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctagtagtgggggataacgtccggaaacgggcgctaataccgcatacgtcctacgggagaaagtgggggatcttcggacctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7265 - DNA, 1547 bp, Pseudomonas sp. NFPP33
  ref <308>: DATABASE ACCESSION NUMBER: NCBI ACCESSION: NZ_FMXG01000015.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctggttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaagaca

SEQ ID NO: 7266 - DNA, 1540 bp, Pseudomonas sp. NP10-3
  ref <308>: DATABASE ACCESSION NUMBER: NCBI ACCESSION: NZ_QKUC01000043.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7267 - DNA, 1540 bp, Pseudomonas sp. NP28-5; identical to SEQ ID NO: 6972
  ref <308>: DATABASE ACCESSION NUMBER: NCBI ACCESSION: NZ_QICP01000039.1
  ref <309>: DATABASE ENTRY DATE: 2019-04-01
  ref <313>: RELEVANT RESIDUES IN SEQ ID NO: (1)..(1540)

SEQ ID NO: 7268 - DNA, 1538 bp, Pseudomonas sp. OV081
  ref <308>: DATABASE ACCESSION NUMBER: NCBI ACCESSION: NZ_QTUD01000048.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatgggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7269 - DNA, 1538 bp, Pseudomonas sp. OV221
  ref <308>: DATABASE ACCESSION NUMBER: NCBI ACCESSION: NZ_QUMR01000024.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacttaatacgttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7270 - DNA, 1538 bp, Pseudomonas sp. OV226
  ref <308>: DATABASE ACCESSION NUMBER: NCBI ACCESSION: NZ_QGGS01000046.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtaacctaatacgttgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatcggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7271 - DNA, 1538 bp, Pseudomonas sp. OV286
  ref <308>: DATABASE ACCESSION NUMBER: NCBI ACCESSION: NZ_QKMB01000062.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcaacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7272 - DNA, 1538 bp, Pseudomonas sp. OV397; identical to SEQ ID NO: 7154
  ref <308>: DATABASE ACCESSION NUMBER: NCBI ACCESSION: NZ_QUNK01000044.1
  ref <309>: DATABASE ENTRY DATE: 2019-04-01
  ref <313>: RELEVANT RESIDUES IN SEQ ID NO: (1)..(1538)

SEQ ID NO: 7273 - DNA, 1538 bp, Pseudomonas sp. OV467
  ref <308>: DATABASE ACCESSION NUMBER: NCBI ACCESSION: NZ_QKLY01000021.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctccttgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttggggtccttgagactttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttctagagatagattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7274 - DNA, 1538 bp, Pseudomonas sp. OV508
  ref <308>: DATABASE ACCESSION NUMBER: NCBI ACCESSION: NZ_QEOF01000024.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggagcttgctcctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7275 - DNA, 1538 bp, Pseudomonas sp. OV529
  ref <308>: DATABASE ACCESSION NUMBER: NCBI ACCESSION: NZ_QKLX01000054.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7276 - DNA, 1538 bp, Pseudomonas sp. OV577
  ref <308>: DATABASE ACCESSION NUMBER: NCBI ACCESSION: NZ_QTUF01000025.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7277 - DNA, 1538 bp, Pseudomonas sp. OV657
  ref <308>: DATABASE ACCESSION NUMBER: NCBI ACCESSION: NZ_QTUH01000034.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacaggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7278 - DNA, 1538 bp, Pseudomonas sp. PAMC 29040
  ref <308>: DATABASE ACCESSION NUMBER: NCBI ACCESSION: NZ_RZAA01000026.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatacctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7279 - DNA, 1540 bp, Pseudomonas sp. PH1b
  ref <308>: DATABASE ACCESSION NUMBER: NCBI ACCESSION: NZ_AYMU01000019.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctagtagtgggggataacgtccggaaacgggcgctaataccgcatacgtcctacgggagaaagtgggggatcttcggacctcacgctattagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7280 - DNA, 1547 bp, Pseudomonas sp. PI11
  ref <308>: DATABASE ACCESSION NUMBER: NCBI ACCESSION: NZ_NIQU01000015.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgtccggaaacgggcgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaarccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaagaca

SEQ ID NO: 7281 - DNA, 1538 bp, Pseudomonas sp. PONIH3
  ref <308>: DATABASE ACCESSION NUMBER: NCBI ACCESSION: NZ_CP026386.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtggggggcaacgtttcgaaaggaacgctaataccgcatacgtcctacgggagaaagcaggggaccttcgggccttgcgctatcagatgagcctaggtcggattagctagtaggtgaggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtacgttaataccgtgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7282 - DNA, 1538 bp, Pseudomonas sp. QC2
  ref <308>: DATABASE ACCESSION NUMBER: NCBI ACCESSION: NZ_PKKS01000020.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7283 - DNA, 1538 bp, Pseudomonas sp. QS1027
  ref <308>: DATABASE ACCESSION NUMBER: NCBI ACCESSION: NZ_PHSU01000041.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaacttcctagagataggttggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccctcgggaggacggttaccacggtgtgattcatgactggggtgaagtcgtaacaaggtagccgtaggggaacctgcggctggatcacctccttaa

SEQ ID NO: 7284 - DNA, 1547 bp, Pseudomonas sp. QTF5
  ref <308>: DATABASE ACCESSION NUMBER: NCBI ACCESSION: NZ_AZRW02000079.1
  ref <309>: DATABASE ENTRY DATE: 2019-04-01
  ref <313>: RELEVANT RESIDUES IN SEQ ID NO: (1)..(1547)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgaca

SEQ ID NO: 7285 - DNA, 1528 bp, Pseudomonas sp. QZS01
  ref <308>: DATABASE ACCESSION NUMBER: NCBI ACCESSION: NZ_CP029822.1
  ref <309>: DATABASE ENTRY DATE: 2019-04-01
  ref <313>: RELEVANT RESIDUES IN SEQ ID NO: (1)..(1528)
aactgaagagtttgatcatggctcagattgaacgctggcggcaggcctaacacatgcaagtcgagcggtaacaggggagcttgctcctgctgacgagcggcggacgggtgagtaaagtctaggaatctgcccagtagtgggggacaacgcggggaaactcgcgctaataccgcatacgccctacgggggaaaggtgctttattgtaccgctattggatgagcctagatcagattagctagttggtggggtaaaggcccaccaaggcgacgatctgtagctggtctgagaggatgatcagccacactgggactgagacacggcccagactcctacgggaggcagcagtggggaatattggacaatgggggaaaccctgatccagccatgccgcgtgtgtgaagaaggtcttcggattgtaaagcactttaagttgggaggaagggcagaagtaacgactctgctttgacgttaccaacagaataagcaccggctaacttcgtgccagcagccgcggtaatacgaagggtgcaagcgttaatcggaattactgggcgtaaagcgcgcgtaggtggtttatcaagttggatgtgaaatccctgggctcaacctaggaactgcatccaaaactgattgactagagtatagtagaggttagtggaatttcctgtgtagcggtgaaatgcgtagatataggaaggaacaccagtggcgaaggcgactaactggactaatactgacactgaggtgcgaaagcgtggggagcaaacaggattagataccctggtagtccacgctgtaaacgatgtcaactagctgttggaatcctagagattttagtagcgtagctaacgcactaagttgaccgcctggggagtacggtcgcaagattaaaactcaaatgaattgacgggggcccgcacaagcggtggagcatgtggtttaattcgacgcaacgcgaagaaccttacctggccttgacatgtccggaatcttgcagagatgcgagagtgccttcgggaatcggaacacaggtgctgcatggctgtcgtcagctcgtgtcgtgagatgttgggttaagtcccgtaacgagcgcaacccttatccttagttaccagcacgtaaaggtgggcactttaaggagactgccggtgacaaaccggaggaaggtggggatgacgtcaagtcatcatggcccttacggccagggctacacacgtgctacaatggttggtacagagggtcgccaaactgtaaagtggagctaatctcaaaaaaccaatcgtagtccggattgaagtctgcaactcgacttcatgaagtcggaatcgctagtaatcgcgaatcagaatgtcgcggtgaatacgttcccgggccttgtacacaccgcccgtcacaccatgggagtgggttgctccagaagtagctaggctaacctcgtgaggccggttaccacggagtgattcatgactggggtgaagtcgtaacaaggtagccgtaggggaacctgcggctggatcacctccttaa

SEQ ID NO: 7286 - DNA, 1538 bp, Pseudomonas sp. R1-43-08
  ref <308>: DATABASE ACCESSION NUMBER: NCBI ACCESSION: NZ_CP027734.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtgtggtagagggtggtggaatttcctgtgtagcggtgaaatgcgtagatataggaaggaacaccagtggcgaaggcgaccacctggaccaacactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7287 - DNA, 1538 bp, Pseudomonas sp. R11-23-07; identical to SEQ ID NO: 7286
  ref <308>: DATABASE ACCESSION NUMBER: NCBI ACCESSION: NZ_CP027761.1
  ref <309>: DATABASE ENTRY DATE: 2019-04-01
  ref <313>: RELEVANT RESIDUES IN SEQ ID NO: (1)..(1538)

SEQ ID NO: 7288 - DNA, 1538 bp, Pseudomonas sp. R2-37-08W; identical to SEQ ID NO: 7286
  ref <308>: DATABASE ACCESSION NUMBER: NCBI ACCESSION: NZ_CP027728.1
  ref <309>: DATABASE ENTRY DATE: 2019-04-01
  ref <313>: RELEVANT RESIDUES IN SEQ ID NO: (1)..(1538)

SEQ ID NO: 7289 - DNA, 1538 bp, Pseudomonas sp. R2-60-08W; identical to SEQ ID NO: 7286
  ref <308>: DATABASE ACCESSION NUMBER: NCBI ACCESSION: NZ_CP027731.1
  ref <309>: DATABASE ENTRY DATE: 2019-04-01
  ref <313>: RELEVANT RESIDUES IN SEQ ID NO: (1)..(1538)

SEQ ID NO: 7290 - DNA, 1538 bp, Pseudomonas sp. R2-7-07; identical to SEQ ID NO: 7286
  ref <308>: DATABASE ACCESSION NUMBER: NCBI ACCESSION: NZ_CP027759.1
  ref <309>: DATABASE ENTRY DATE: 2019-04-01
  ref <313>: RELEVANT RESIDUES IN SEQ ID NO: (1)..(1538)

SEQ ID NO: 7291 - DNA, 1538 bp, Pseudomonas sp. R3-18-08; identical to SEQ ID NO: 7286
  ref <308>: DATABASE ACCESSION NUMBER: NCBI ACCESSION: NZ_CP027729.1
  ref <309>: DATABASE ENTRY DATE: 2019-04-01
  ref <313>: RELEVANT RESIDUES IN SEQ ID NO: (1)..(1538)

SEQ ID NO: 7292 - DNA, 1538 bp, Pseudomonas sp. R3-52-08; identical to SEQ ID NO: 7286
  ref <308>: DATABASE ACCESSION NUMBER: NCBI ACCESSION: NZ_CP027730.1
  ref <309>: DATABASE ENTRY DATE: 2019-04-01
  ref <313>: RELEVANT RESIDUES IN SEQ ID NO: (1)..(1538)

SEQ ID NO: 7293 - DNA, 1538 bp, Pseudomonas sp. R4-34-07
  ref <308>: DATABASE ACCESSION NUMBER: NCBI ACCESSION: NZ_CP027760.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtgtggtagagggtggtggaatttcctgtgtagcggtgaaatgcgtagatataggaaggaacaccagtggcgaaggcgaccacctggaccaacactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7294 - DNA, 1538 bp, Pseudomonas sp. R4-35-07; identical to SEQ ID NO: 7293
  ref <308>: DATABASE ACCESSION NUMBER: NCBI ACCESSION: NZ_CP027732.1
  ref <309>: DATABASE ENTRY DATE: 2019-04-01
  ref <313>: RELEVANT RESIDUES IN SEQ ID NO: (1)..(1538)

SEQ ID NO: 7295 - DNA, 1538 bp, Pseudomonas sp. R4-39-08; identical to SEQ ID NO: 7293
  ref <308>: DATABASE ACCESSION NUMBER: NCBI ACCESSION: NZ_CP027733.1
  ref <309>: DATABASE ENTRY DATE: 2019-04-01
  ref <313>: RELEVANT RESIDUES IN SEQ ID NO: (1)..(1538)

SEQ ID NO: 7296 - DNA, 1538 bp, Pseudomonas sp. R5-89-07
  ref <308>: DATABASE ACCESSION NUMBER: NCBI ACCESSION: NZ_CP027727.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacttaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtgtggtagagggtggtggaatttcctgtgtagcggtgaaatgcgtagatataggaaggaacaccagtggcgaaggcgaccacctggaccaacactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7297 - DNA, 1538 bp, Pseudomonas sp. RIT 409
  ref <308>: DATABASE ACCESSION NUMBER: NCBI ACCESSION: NZ_QARE02000047.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctccctgattcagcggcggacgggtgagtaatgcctaggaatctgcctggtagtgggggacaacgtctcgaaagggacgctaataccgcatacgtcctacgggagaaagtgggggctcttcggacctcacgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtacgttaataccgtgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccagtgaacttgccagagatggcttggtgccttcgggaacactgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7298 - DNA, 1537 bp, Pseudomonas sp. RIT 411
  ref <308>: DATABASE ACCESSION NUMBER: NCBI ACCESSION: NZ_QBIZ02000036.1
  ref <309>: DATABASE ENTRY DATE: 2019-04-01
  ref <313>: RELEVANT RESIDUES IN SEQ ID NO: (1)..(1537)
aactgaagagtttgatcatggctcagattgaacgctggcggcaggcctaacacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtcgtaacaaggtagccgtaggggaacctgcggctggatcacctccttaa

SEQ ID NO: 7299 - DNA, 560 bp, Pseudomonas sp. RIT 412
  ref <308>: DATABASE ACCESSION NUMBER: NCBI ACCESSION: NZ_QBJA02000044.1
  ref <309>: DATABASE ENTRY DATE: 2019-04-01
  ref <313>: RELEVANT RESIDUES IN SEQ ID NO: (1)..(560)
gcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactca

SEQ ID NO: 7300 - DNA, 1538 bp, Pseudomonas sp. RU47
  ref <308>: DATABASE ACCESSION NUMBER: NCBI ACCESSION: NZ_CP022411.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctagatcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7301 - DNA, 1538 bp, Pseudomonas sp. RW405; identical to SEQ ID NO: 6970
  ref <308>: DATABASE ACCESSION NUMBER: NCBI ACCESSION: NZ_QHJD01000009.1
  ref <309>: DATABASE ENTRY DATE: 2019-04-01
  ref <313>: RELEVANT RESIDUES IN SEQ ID NO: (1)..(1538)

SEQ ID NO: 7302 - DNA, 1538 bp, Pseudomonas sp. RW407
  ref <308>: DATABASE ACCESSION NUMBER: NCBI ACCESSION: NZ_QGSL01000091.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctctctgattcagcggcggacgggtgagtaatgcctaggaatctgcctggtagtgggggacaacgttccgaaagggacgctaataccgcatacgtcctacgggagaaagtgggggatcttcggacctcacgctatcagatgagcctaggtcggattagctagtaggtggggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggctgcaagttaataccttgtagttttgacgttaccaacagaataagcaccggctaacttcgtgccagcagccgcggtaatacgaagggtgcaagcgttaatcggaattactgggcgtaaagcgcgcgtaggtggtttggtaagatggatgtgaaatccccgggctcaacctgggaactgcatccataactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacagagggttgccaagccgcgaggcggagctaatcccagaaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7303 - DNA, 1538 bp, Pseudomonas sp. RW409; identical to SEQ ID NO: 7190
  ref <308>: DATABASE ACCESSION NUMBER: NCBI ACCESSION: NZ_QHHP01000042.1
  ref <309>: DATABASE ENTRY DATE: 2019-04-01
  ref <313>: RELEVANT RESIDUES IN SEQ ID NO: (1)..(1538)

SEQ ID NO: 7304 - DNA, 1538 bp, Pseudomonas sp. S09F 262; identical to SEQ ID NO: 7062
  ref <308>: DATABASE ACCESSION NUMBER: NCBI ACCESSION: NZ_PHII01000001.1
  ref <309>: DATABASE ENTRY DATE: 2019-04-01
  ref <313>: RELEVANT RESIDUES IN SEQ ID NO: (1)..(1538)

SEQ ID NO: 7305 - DNA, 1538 bp, Pseudomonas sp. S09G 359
  ref <308>: DATABASE ACCESSION NUMBER: NCBI ACCESSION: NZ_CP025263.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccctcgggaggacggttaccacggtgtgattcatgactggggtgaagtcgtaacaaggtagccgtaggggaacctgcggctggatcacctccttaa

SEQ ID NO: 7306 - DNA, 1538 bp, Pseudomonas sp. S10E 269; identical to SEQ ID NO: 7062
  ref <308>: DATABASE ACCESSION NUMBER: NCBI ACCESSION: NZ_PHIJ01000001.1
  ref <309>: DATABASE ENTRY DATE: 2019-04-01
  ref <313>: RELEVANT RESIDUES IN SEQ ID NO: (1)..(1538)

SEQ ID NO: 7307 - DNA, 1538 bp, Pseudomonas sp. S1E44
  ref <308>: DATABASE ACCESSION NUMBER: NCBI ACCESSION: NZ_PYWW01000017.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7308 - DNA, 1538 bp, Pseudomonas sp. S5D5
  ref <308>: DATABASE ACCESSION NUMBER: NCBI ACCESSION: NZ_PTEO01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7309 - DNA, 1538 bp, Pseudomonas sp. SCT
  ref <308>: DATABASE ACCESSION NUMBER: NCBI ACCESSION: NZ_BDJA01000022.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagtggagcttgctccatgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7310 - DNA, 1538 bp, Pseudomonas sp. SDI
  ref <308>: DATABASE ACCESSION NUMBER: NCBI ACCESSION: NZ_QETK01000059.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccaacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttctagagatagattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7311 - DNA, 1538 bp, Pseudomonas sp. SMT-1
  ref <308>: DATABASE ACCESSION NUMBER: NCBI ACCESSION: NZ_QJOV01000061.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7312 - DNA, 1537 bp, Pseudomonas sp. SSM26
  ref <308>: DATABASE ACCESSION NUMBER: NCBI ACCESSION: NZ_RKKU01000016.1
  ref <309>: DATABASE ENTRY DATE: 2019-04-01
  ref <313>: RELEVANT RESIDUES IN SEQ ID NO: (1)..(1537)
aactgaagagtttgatcatggctcagattgaacgctggcggcaggcctaacacatgcaagtcgagcggtagaaggaagcttgcttcctttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagcttgttggtgaggtaatggctcaccaaggcaacgatccgtaactggtctgagaggatgatcagtcacactggaactgagacacggtccagactcctacgggaggcagcagtggggaatattggacaatgggggaaaccctgatccagccatgccgcgtgtgtgaagaaggtcttaggattgtaaagcactttaagttgggaggaagggttatagcctaatacgctgtaactttgacgttaccgacagaataagcaccggctaactctgtgccagcagccgcggtaatacagagggtgcaagcgttaatcggaattactgggcgtaaagcgcgcgtaggtggcaaagtaagatgggtgtgaaatccccgggctcaacctgggaactgcatccataactgcttcgctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggaaccttgagttcttagtggcgcagctaacgcactaagttgaccgcctggggagtacggtcgcaagattaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcaagtcatcatggcccttacggccagggctacacacgtgctacaatgggggatacagagggttgccaagccgcgaggtggagctaatcccacaaagtctctcgtagtccggattggagtctgcaactcgactccatgaagtcggaatcgctagtaatcgtggatcagaacgccacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7313 - DNA, 1537 bp, Pseudomonas sp. SSM44; identical to SEQ ID NO: 7312
  ref <308>: DATABASE ACCESSION NUMBER: NCBI ACCESSION: NZ_RKKV01000017.1
  ref <309>: DATABASE ENTRY DATE: 2019-04-01
  ref <313>: RELEVANT RESIDUES IN SEQ ID NO: (1)..(1537)

SEQ ID NO: 7314 - DNA, 1538 bp, Pseudomonas sp. SWI36; identical to SEQ ID NO: 7106
  ref <308>: DATABASE ACCESSION NUMBER: NCBI ACCESSION: NZ_SEIS01000185.1
  ref <309>: DATABASE ENTRY DATE: 2019-04-01
  ref <313>: RELEVANT RESIDUES IN SEQ ID NO: (1)..(1538)

SEQ ID NO: 7315 - DNA, 1538 bp, Pseudomonas sp. SWI44
  ref <308>: DATABASE ACCESSION NUMBER: NCBI ACCESSION: NZ_CP026674.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtggggggcaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7316 - DNA, 1538 bp, Pseudomonas sp. SWI6
  ref <308>: DATABASE ACCESSION NUMBER: NCBI ACCESSION: NZ_CP026676.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcgcgttatggtgggcactctagggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7317 - DNA, 1538 bp, Pseudomonas sp. SpeckC; identical to SEQ ID NO: 7068
  ref <308>: DATABASE ACCESSION NUMBER: NCBI ACCESSION: NZ_UYJC01000046.1
  ref <309>: DATABASE ENTRY DATE: 2019-04-01
  ref <313>: RELEVANT RESIDUES IN SEQ ID NO: (1)..(1538)

SEQ ID NO: 7318 - DNA, 1538 bp, Pseudomonas sp. T3
  ref <308>: DATABASE ACCESSION NUMBER: NCBI ACCESSION: NZ_RBZQ01000016.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggcagcgggtccttcgggatgccggcgagcggcggacgggtgagtaatgcctaggaatctgcctggtagtgggggataactcggggaaactcgagctaataccgcatacgtcctacgggagaaagtgggggatcttcggacctcacgctatcagatgagcctaggtcggattagctagtaggtgaggtaaaggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagctgggaggaagggcagtaagttaataccttgctgttttgacgttaccagcagaataagcaccggctaactctgtgccagcagccgcggtaatacagagggtgcaagcgttaatcggaattactgggcgtaaagcgcgcgtaggtggtttgataagttggatgtgaaagccctgggctcaacctgggaactgcatccaaaactgtctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttggggtccttgagactttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaacgtcgcggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7319 - DNA, 1538 bp, Pseudomonas sp. TAA207
  ref <308>: DATABASE ACCESSION NUMBER: NCBI ACCESSION: NZ_LLWJ01000024.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatacctaggaatctgcctgatagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7320 - DNA, 1540 bp, Pseudomonas sp. TKO14
  ref <308>: DATABASE ACCESSION NUMBER: NCBI ACCESSION: NZ_QKLO01000029.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctagtagtgggggataacgtccggaaacgggcgctaataccgcatacgtcctacgggagaaagtgggggatcttcggacctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7321 - DNA, 1540 bp, Pseudomonas sp. TKO26; identical to SEQ ID NO: 7320
  ref <308>: DATABASE ACCESSION NUMBER: NCBI ACCESSION: NZ_QKLN01000028.1
  ref <309>: DATABASE ENTRY DATE: 2019-04-01
  ref <313>: RELEVANT RESIDUES IN SEQ ID NO: (1)..(1540)

SEQ ID NO: 7322 - DNA, 1540 bp, Pseudomonas sp. TKO29; identical to SEQ ID NO: 7320
  ref <308>: DATABASE ACCESSION NUMBER: NCBI ACCESSION: NZ_QKLM01000027.1
  ref <309>: DATABASE ENTRY DATE: 2019-04-01
  ref <313>: RELEVANT RESIDUES IN SEQ ID NO: (1)..(1540)

SEQ ID NO: 7323 - DNA, 1540 bp, Pseudomonas sp. TKO30; identical to SEQ ID NO: 7320
  ref <308>: DATABASE ACCESSION NUMBER: NCBI ACCESSION: NZ_QKLL01000028.1
  ref <309>: DATABASE ENTRY DATE: 2019-04-01
  ref <313>: RELEVANT RESIDUES IN SEQ ID NO: (1)..(1540)

SEQ ID NO: 7324 - DNA, 1538 bp, Pseudomonas sp. TMW 2.1634
  ref <308>: DATABASE ACCESSION NUMBER: NCBI ACCESSION: NZ_CP016849.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatacctaggaatctgcctgatagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7325 - DNA, 1333 bp, Pseudomonas sp. URIL14HWK12 I10
  ref <308>: DATABASE ACCESSION NUMBER: NCBI ACCESSION: NZ_QEQP01000019.1
  ref <309>: DATABASE ENTRY DATE: 2019-04-01
  ref <313>: RELEVANT RESIDUES IN SEQ ID NO: (1)..(1333)
ggcctcacgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggctgtaggttaataccttgcagttttgacgttaccgacagaataagcaccggctaactctgtgccagcagccgcggtaatacagagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatataggaaggaacatcagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7326 - DNA, 1323 bp, Pseudomonas sp. URIL14HWK12 I11
  ref <308>: DATABASE ACCESSION NUMBER: NCBI ACCESSION: NZ_QEQR01000018.1
  ref <309>: DATABASE ENTRY DATE: 2019-04-01
  ref <313>: RELEVANT RESIDUES IN SEQ ID NO: (1)..(1323)
ggcctcacgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggctgtaggttaataccttgcagttttgacgttaccgacagaataagcaccggctaactctgtgccagcagccgcggtaatacagagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatataggaaggaacatcagtggcgaaggcgaccacctggactgatactgacactgaggtgcgaaagcgtggggagcaaacaggattagataccctggtagtccacgccgtaaacgatgtcaactagccgttggggtccttgagactttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatc

SEQ ID NO: 7327 - DNA, 1333 bp, Pseudomonas sp. URIL14HWK12 I12; identical to SEQ ID NO: 7325
  ref <308>: DATABASE ACCESSION NUMBER: NCBI ACCESSION: NZ_QEQL01000017.1
  ref <309>: DATABASE ENTRY DATE: 2019-04-01
  ref <313>: RELEVANT RESIDUES IN SEQ ID NO: (1)..(1333)

SEQ ID NO: 7328 - DNA, 1144 bp, Pseudomonas sp. URIL14HWK12 I3
  ref <308>: DATABASE ACCESSION NUMBER: NCBI ACCESSION: NZ_QKYY01000043.1
  ref <309>: DATABASE ENTRY DATE: 2019-04-01
  ref <313>: RELEVANT RESIDUES IN SEQ ID NO: (1)..(1144)
gagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggtt

SEQ ID NO: 7329 - DNA, 1251 bp, Pseudomonas sp. URMO17WK12 I1
  ref <308>: DATABASE ACCESSION NUMBER: NCBI ACCESSION: NZ_QKZB01000015.1
  ref <309>: DATABASE ENTRY DATE: 2019-04-01
  ref <313>: RELEVANT RESIDUES IN SEQ ID NO: (1)..(1251)
gaactgaagagtttgatcatggctcagattgaacgctggcggcaggcctaacacatgcaagtcgagcggttgacgggagcttgctccctgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggaactctaaggagactgccggtgacaaaccggaggaaggtggggatgacgtcaagtcatcatggcccttacggccagggctacacacgtgctacaatggtcggtacaaagggtt

SEQ ID NO: 7330 - DNA, 1538 bp, Pseudomonas sp. URMO17WK12 I2
  ref <308>: DATABASE ACCESSION NUMBER: NCBI ACCESSION: NZ_QKYW01000022.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggttgacgggagcttgctccctgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7331 - DNA, 1375 bp, Pseudomonas sp. VI4.1
  ref <308>: DATABASE ACCESSION NUMBER: NCBI ACCESSION: NZ_MULM01000008.1
  ref <309>: DATABASE ENTRY DATE: 2019-04-01
  ref <313>: RELEVANT RESIDUES IN SEQ ID NO: (1)..(1375)
taataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccctcgggaggacggttaccacggtgtgattcatgactggggtgaagtcgtaacaaggtagccgtaggggaacctgcggctggatcacctccttaa

SEQ ID NO: 7332 - DNA, 1538 bp, Pseudomonas sp. WCHP16; identical to SEQ ID NO: 7075
  ref <308>: DATABASE ACCESSION NUMBER: NCBI ACCESSION: NZ_MBPN01000186.1
  ref <309>: DATABASE ENTRY DATE: 2019-04-01
  ref <313>: RELEVANT RESIDUES IN SEQ ID NO: (1)..(1538)

SEQ ID NO: 7333 - DNA, 1538 bp, Pseudomonas sp. WCHPs060039
  ref <308>: DATABASE ACCESSION NUMBER: NCBI ACCESSION: NZ_QKVM01000121.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7334 - DNA, 1538 bp, Pseudomonas sp. WCHPs060044
  ref <308>: DATABASE ACCESSION NUMBER: NCBI ACCESSION: NZ_QKVL01000087.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7335 - DNA, 1538 bp, Pseudomonas sp. WCS365
  ref <308>: DATABASE ACCESSION NUMBER: NCBI ACCESSION: NZ_PHHS01000040.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7336 - DNA, 1542 bp, Pseudomonas sp. WN033
  ref <308>: DATABASE ACCESSION NUMBER: NCBI ACCESSION: NZ_NSKG01000020.1
  ref <309>: DATABASE ENTRY DATE: 2019-04-01
  ref <313>: RELEVANT RESIDUES IN SEQ ID NO: (1)..(1542)
gaactgaagagtttgatcatggctcagattgaacgctggcgccaggcctaacacatgcaagtcgagcggatgaagggagcttcctcctggattcagcggcggaccggtgagtaaagcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagggatgccgcgtgtgtgaagaaggtcttcggattctaaagcactttaagttcggaggaagagcagtcgattaatactctgctgttttgacgttaccaacagaataagcaccggctaactctgtgccagcagccgcggtaatacagagggtgcaagcgttaatcggaattactgggcgtaaagcgcgcgtaggcgggtaggtaagatgggtgtgaaatccccgggctcaacctgggaactgcatccataactgcctggctagagtacagtagagggtggtggaatttcctgtgtagcggtgaaatgcgtagatataggaaggaacaccagtggcgaaggcgaccacctggactgatagtgacgctgaggtgcgaaagcgtggggagcaaacaggattagataccctggtagtccacgccgtaaacgatgtcaactagccgttggaatccttgagattttagtggcgcagctaacgcactaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatgggcggtacagagggttgccaagccgcgaggtggagctaatcccttaaaaccgttcgtagtccggattggagtctgcaactcgactccatgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcga

SEQ ID NO: 7337 - DNA, 1129 bp, Pseudomonas sp. WPR 5 2
  ref <308>: DATABASE ACCESSION NUMBER: NCBI ACCESSION: NZ_RBLA01000015.1
  ref <309>: DATABASE ENTRY DATE: 2019-04-01
  ref <313>: RELEVANT RESIDUES IN SEQ ID NO: (1)..(1129)
gaactgaagagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggatcggtgccttcgggaacattgagacaggtgctgcatggctgtcgtcagctcgtgtcgtgagatgttgggttaagtcccgtaacgagcgcaacccttgtccttagttaccagcaca

SEQ ID NO: 7338 - DNA, 1538 bp, Pseudomonas sp. XWY-1; identical to SEQ ID NO: 6970
  ref <308>: DATABASE ACCESSION NUMBER: NCBI ACCESSION: NZ_CP026332.1
  ref <309>: DATABASE ENTRY DATE: 2019-04-01
  ref <313>: RELEVANT RESIDUES IN SEQ ID NO: (1)..(1538)

SEQ ID NO: 7339 - DNA, 1538 bp, Pseudomonas sp. YY-1
  ref <308>: DATABASE ACCESSION NUMBER: NCBI ACCESSION: NZ_PJLX01000029.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgtccggaaacgggcgctaataccgcgtacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7340 - DNA, 279 bp, Pseudomonas sp. ZH-FAD
  ref <308>: DATABASE ACCESSION NUMBER: NCBI ACCESSION: NZ_PGLR01000009.1
  ref <309>: DATABASE ENTRY DATE: 2019-04-01
  ref <313>: RELEVANT RESIDUES IN SEQ ID NO: (1)..(279)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgtccggaaacgggcgctaataccgcatacgtcctacgggagaaagcaggggaccttcgggccttgcgctatcagatgagcctaggtcggattagctagttggtgaggtaatggctcaccaaggcgacgatcc

SEQ ID NO: 7341 - DNA, 1538 bp, Pseudomonas sp. o96-267
  ref <308>: DATABASE ACCESSION NUMBER: NCBI ACCESSION: NZ_RHQP01000069.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaggagcttgctccttgatttagcggcggacgggtgagtaatgcctaggaatctgcctggtagtgggggataacgtccggaaacgggcgctaataccgcatacgtcctacgggagaaagcaggggacctttgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7342 - DNA, 1538 bp, Pseudomonas sp. p106
  ref <308>: DATABASE ACCESSION NUMBER: NCBI ACCESSION: NZ_RHQR01000043.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7343 - DNA, 1538 bp, Pseudomonas sp. p99-361
  ref <308>: DATABASE ACCESSION NUMBER: NCBI ACCESSION: NZ_RHQS01000168.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7344 - DNA, 1538 bp, Pseudomonas sp. phDV1; identical to SEQ ID NO: 7002
  ref <308>: DATABASE ACCESSION NUMBER: NCBI ACCESSION: NZ_CP031606.1
  ref <309>: DATABASE ENTRY DATE: 2019-04-01
  ref <313>: RELEVANT RESIDUES IN SEQ ID NO: (1)..(1538)

SEQ ID NO: 7345 - DNA, 1538 bp, Pseudomonas sp. s199
  ref <308>: DATABASE ACCESSION NUMBER: NCBI ACCESSION: NZ_RHQQ01000041.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaagggagcttgctccctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggctgcgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaacttcgtgccagcagccgcggtaatacgaagggtgcaagcgttaatcggaattactgggcgtaaagcgcgcgtaggtggtttgttaagttggaagtgaaagccccgggctcaacctgggaactgctttcaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggctccttgagagcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7346 - DNA, 1538 bp, Pseudomonas sp. s211 2017
  ref <308>: DATABASE ACCESSION NUMBER: NCBI ACCESSION: NZ_CP024081.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaaagcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7347 - DNA, 1452 bp, Pseudomonas sp. v388
  ref <308>: DATABASE ACCESSION NUMBER: NCBI ACCESSION: NZ_RHQN01000020.1
  ref <309>: DATABASE ENTRY DATE: 2019-04-01
  ref <313>: RELEVANT RESIDUES IN SEQ ID NO: (1)..(1452)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatccttgagagatcagggagtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggg

SEQ ID NO: 7348 - DNA, 1544 bp, Pseudomonas straminea
  ref <308>: DATABASE ACCESSION NUMBER: NCBI ACCESSION: NZ_FOMO01000019.1
  ref <309>: DATABASE ENTRY DATE: 2019-04-01
  ref <313>: RELEVANT RESIDUES IN SEQ ID NO: (1)..(1544)
gaactgaagagtttgatcatggctcagattgaacgctggcggcaggcctaacacatgcaagtcgagcggttgaggggagcttgctccctgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggaactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgaaga

SEQ ID NO: 7349 - DNA, 1538 bp, Pseudomonas stutzeri
  ref <308>: DATABASE ACCESSION NUMBER: NCBI ACCESSION: NZ_LR134482.1
  ref <309>: DATABASE ENTRY DATE: 2019-04-01
  ref <313>: RELEVANT RESIDUES IN SEQ ID NO: (1)..(1538)
gagctgaagagtttgatcatggctcagattgaacgctggcggcaggcctaacacatgcaagtcgagcggatgaagagagcttgctctctgattcagcggcggacgggtgagtaatgcctaggaatctgcctgatagtgggggacaacgtttcgaaaggaacgctaataccgcatacgtcctacgggagaaagcaggggaccttcgggccttgcgctatcagatgagcctaggtcggattagctagttggtgaggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttgaatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaa

SEQ ID NO: 7350 - DNA, 1540 bp, Pseudomonas syringae
  ref <308>: DATABASE ACCESSION NUMBER: NCBI ACCESSION: NZ_OLMP01000002.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctgggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7351 - DNA, 1540 bp, Pseudomonas syringae group genomosp. 3
  ref <308>: DATABASE ACCESSION NUMBER: NCBI ACCESSION: NZ_OLMQ01000003.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtatctgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggagcattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7352 - DNA, 1540 bp, Pseudomonas syringae group genomosp. 7
  ref <308>: DATABASE ACCESSION NUMBER: NCBI ACCESSION: NZ_RBVF01000047.1
  ref <309>: DATABASE ENTRY DATE: 2019-04-01
  ref <313>: RELEVANT RESIDUES IN SEQ ID NO: (1)..(1540)
gaactgaagagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgactgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaaccttccagagatggaggggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccacggtgtgattcatgactggggtgaagtcgtaacaaggtagccgtaggggaacctgcggctggatcacctccttaa

SEQ ID NO: 7353 - DNA, 1538 bp, Pseudomonas taetrolens
  ref <308>: DATABASE ACCESSION NUMBER: NCBI ACCESSION: NZ_LR134393.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcatctcttgagagcggcggacgggtgagtaatacctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7354 - DNA, 1538 bp, Pseudomonas taiwanensis
  ref <308>: DATABASE ACCESSION NUMBER: NCBI ACCESSION: NZ_AXUP01000437.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagytaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7355 - DNA, 1538 bp, Pseudomonas tolaasii
  ref <308>: DATABASE ACCESSION NUMBER: NCBI ACCESSION: NZ_PHHD01000001.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagtttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7356 - DNA, 1538 bp, Pseudomonas veronii; identical to SEQ ID NO: 7150
  ref <308>: DATABASE ACCESSION NUMBER: NCBI ACCESSION: NZ_ML137264.1
  ref <309>: DATABASE ENTRY DATE: 2019-04-01
  ref <313>: RELEVANT RESIDUES IN SEQ ID NO: (1)..(1538)

SEQ ID NO: 7357 - DNA, 1538 bp, Pseudomonas versuta
  ref <308>: DATABASE ACCESSION NUMBER: NCBI ACCESSION: NZ_MPJC01000023.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagaggtgcttgcacctcttgagagcggcggacgggtgagtaatacctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgctttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7358 - DNA, 1538 bp, Pseudomonas vranovensis
  ref <308>: DATABASE ACCESSION NUMBER: NCBI ACCESSION: NZ_MOAM01000020.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7359 - DNA, 1538 bp, Pseudomonas wadenswilerensis
  ref <308>: DATABASE ACCESSION NUMBER: NCBI ACCESSION: NZ_UIDD01000012.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgccctacgggggaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttacctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 7360 - DNA, 1541 bp, Pseudomonas xinjiangensis
  ref <308>: DATABASE ACCESSION NUMBER: NCBI ACCESSION: NZ_LT629736.1
  ref <309>: DATABASE ENTRY DATE: 2019-04-01
  ref <313>: RELEVANT RESIDUES IN SEQ ID NO: (1)..(1541)
aactgaagagtttgatcatggctcagattgaacgctggcggcaggcctaacacatgcaagtcgagcggtagaggggagcttgctccccttgagagcggcggacgggtgagtaacacctgggaatctgcctggtagtgggggataacgttccgaaaggaacgctaataccgcatacgtcctacgggagaaagcaggggatcttcggaccttgcgctatcagatgagcccaggtcggattagctagtaggtgaggtaatggctcacctaggcgacgatccgtaactggtctgagaggatgatcagtcacactggaactgagacacggtccagactcctacgggaggcagcagtggggaatattggacaatgggcgcaagcctgatccagccatgccgcgtgtgtgaagaaggtcttcggattgtaaagcactttaagttgggaggaagggaagtaagctaataccttgctttcttgacgttaccaacagaataagcaccggctaactctgtgccagcagccgcggtaatacagagggtgcaagcgttaatcggaattactgggcgtaaagcgcgcgtaggtggctaagtaagatgggtgtgaaatccccgggctcaacctgggaactgcatccataactgcttagctagagtacggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttggaatccttgagattttagtggcgcagctaacgcaataagttgaccgcctggggagtacggtcgcaagattaaaactcaaatgaattgacgggggcccgcacaagcggtggagcatgtggtttaattcgaagcaacgcgaagaaccttacctggccttgacatgctgagaaccttccagagatggaagggtgccttcgggaactcagacacaggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacagagggtcgccaagccgcgaggtggagctaatcccttaaaaccgatcgtagtccggattggagtctgcaactcgactccatgaagtcggaatcgctagtaatcgcgaatcagaacgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcga

SEQ ID NO: 7361 - DNA, 1538 bp, Pseudomonas zhaodongensis
  ref <308>: DATABASE ACCESSION NUMBER: NCBI ACCESSION: NZ_RFFM01000015.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgaatggagcttgctccatgattcagcggcggacgggtgagtaatgcctaggaatctgcctattagtgggggacaacgtttcgaaaggaacgctaataccgcatacgtcctacgggagaaagcaggggaccttcgggccttgcgctaatagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttggatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtaggggaacctgcggctggatcacctccttaa

SEQ ID NO: 7362 - DNA, 1528 bp, Pseudonocardia autotrophica
  ref <308>: DATABASE ACCESSION NUMBER: NCBI ACCESSION: NZ_AP018920.1
  ref <309>: DATABASE ENTRY DATE: 2019-04-01
  ref <313>: RELEVANT RESIDUES IN SEQ ID NO: (1)..(1528)
ttgttggagagtttgatcctggctcaggacgaacgctggcggcgtgcttaacacatgcaagtcgagcggtaaggccctttcgggggtacacgagcggcgaacgggtgagtaacacgtgggtgacctgccctccactctgggataagcccgggaaactgggtctaataccggataggacacgttgatgcatgtcttcgtgtggaaagttttttcggtgggggatgggcccgcggcctatcagcttgttggtggggtgatggcctaccaaggcggtgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcgccagggacgaagagcaattgacggtacctggagaagaagcaccggccaactacgtgccagcagccgcggtaacacgtagggtgcgagcgttgtccggaattattgggcgtaaagagctcgtaggcggtgtgtcgcgtcgatcgtgaaaacttggggcttaactctgagcgtgcggtcgatacgggcatcacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacgttgggcgctaggtgtggggaccattccacggtttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcacaggaccgcggcagagatgtcgtttcccttgtggcctgtgtgcaggtggtgcatggctgtcgtcagctcgtgtcgtgagatgttgggttaagtcccgcaacgagcgcaacccttgttccatgttgccagcacgtaatggtggggactcatgggagactgccggggtcaactcggaggaaggtggggatgacgtcaagtcatcatgccccttatgtccagggcttcacacatgctacaatggctcatacagagggctgcgagaccgtgaggtggagcgaatcccttaaagtgagtctcagttcggatcggggtctgcaactcgaccccgtgaagttggagtcgctagtaatcgcagatcagcaacgctgcggtgaatacgttcccgggccttgtacacaccgcccgtcacgtcacgaaagttggtaacacccgaagccggcggcccaacccttgtggagggagctgtcgaaggtgggactggcgattgggacgaagtcgtaacaaggtagccgtaccggaaggtgcggctggatcacctcctttctaaggag

SEQ ID NO: 7363 - DNA, 1520 bp, Pseudonocardiaceae bacterium YIM PH 21723
  ref <308>: DATABASE ACCESSION NUMBER: NCBI ACCESSION: NZ_QZFT01000110.1
  ref <309>: DATABASE ENTRY DATE: 2019-04-01
  ref <313>: RELEVANT RESIDUES IN SEQ ID NO: (1)..(1520)
tggagagtttgatcctggctcaggacgaacgctggcggcgtgcttaacacatgcaagtcgagcggtaaggcccttcggggtacacgagcggcgaacgggtgagtaacacgtgggcaacctgcccttcacttcgggataagcccgggaaactgggtctaataccggatacgaaccactagggcatcttggtggttggaaagttccggcggtgaaggatgggcccgcggcctatcagcttgttggtggggtaaaagcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgactgccttcgggttgtaaacctctttcagtagggacgaagcgcaagtgacggtacctacagaagaagcaccggctaactacgtgccagcagccgcggtaatacgtagggtgcaagcgttgtccggaattattgggcgtaaagagctcgtaggcggtttgttgcgtcggtcgtgaaaacttgaggcttaacctcaagcttgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggtgctaggtgtgggggacttccacgtcctccgtgccgtcgctaacgcattaagcaccccgcctggggagtacggtcgcaagactaaaactcaaaggaattgacgggggcccgcacaagcggcggagcatgtggattaattcgatgcaacgcgaagaaccttacctgggtttgacatacaccggaaactgccagagatggtagccccgtaaggtcggtgtacaggtggtgcatggctgtcgtcagctcgtgtcgtgagatgttgggttaagtcccgcaacgagcgcaacccttgttctatgttgccagcacgtaatggtggggactcataggagactgccggggtcaactcggaggaaggtggggatgacgtcaagtcatcatgccccttatgtccagggcttcacacatgctacaatggccggtacagagggctgcgagaccgcgaggtggagcgaatcccttaaagccggtctcagttcggattggggtctgcaactcgaccccatgaagttggagtcgctagtaatcgcagatcagcaacgctgcggtgaatacgttcccgggccttgtacacaccgcccgtcacgtcacgaaagtcggtaacacccgaagccggtggcccaacccgtaagggagggagctgtcgaaggtgggactggcgattgggacgaagtcgtaacaaggtagccgtaccggaaggtgcggctggatcacctcctttctaaggag

SEQ ID NO: 7364 - DNA, 1469 bp, Pseudooceanicola atlanticus
  ref <308>: DATABASE ACCESSION NUMBER: NCBI ACCESSION: NZ_AQQX01000038.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaatgtacccttcactgcggaatagccactggaaacggtgagtaataccgcatacgcccttcgggggaaagatttatcggtgaaggatcagcccgcgtctgattagatagttggtggggtaacggcctaccaagtcgacgatcagtagctggttttagaggatgatcagcaacactgggactgagacacggcccagactcctacgggaggcagcagtggggaatcttagacaatgggcgcaagcctgatctagccatgccgcgtgtgtgatgaaggccctagggtcgtaaagcactttcgccagggatgataatgacagtacctggtaaagaaaccccggctaactccgtgccagcagccgcggtaatacggagggggttagcgttgttcggaattactgggcgtaaagcgcacgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccacgtccagagatggaccgttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtatctacagtgggttaatccccaaaagatatctcagttcggattgttctctgcaactcgagagcatgaagtcggaatcgctagtaatcgcgtaacagcatgacgcggtgaatacgttcccgggccttgtacacaccgcccgtcacatcatgggagttgggtttacccgaagacggtgcgccaacctttcgagggggcagctggccacggtaggctcagcgactgggatgaagtcgtaacaaggtagccgtaggggaacctgcggctggatcacctcctttctaa

SEQ ID NO: 7365 - DNA, 1471 bp, Pseudooceanicola batsensis
  ref <308>: DATABASE ACCESSION NUMBER: NCBI ACCESSION: NZ_CH724131.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgaagccttcgggcttagcggcggacgggtgagtaacgcgtgggaatgtacccttctctgcggaatagccactggaaacggtgagtaataccgcatacgcccttcgggggaaagatttatcggagaaggatcagcccgcgtctgattagatagttggtggggtaacggcctaccaagtcgacgatcagtagctggttttagaggatgatcagccacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatggagagatccatggttcccttcggggacgcagtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcagtgacaatgggttaatccccaaaaactgtctcagttcggattgtcgtctgcaactcgacggcatgaagtcggaatcgctagtaatcgcgtaacagcatgacgcggtgaatacgttcccgggccttgtacacaccgcccgtcacatcatgggagttgggtttacccgaagacggtgcgccaacctgttcgcagggggcagctggccacggtaggctcagcgactgggatgaagtcgtaacaaggtagccgtaggggaacctgcggctggatcacctcctttctaa

SEQ ID NO: 7366 - DNA, 1469 bp, Pseudooceanicola lipolyticus
  ref <308>: DATABASE ACCESSION NUMBER: NCBI ACCESSION: NZ_PGTB01000197.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcaccttcgggtgagcggcggacgggttagtaacgcgtgggaacgtgcccttctctgcggaatagccactggaaacggtgagtaataccgcatacgcccttcgggggaaagatttatcggagaaggatcggcccgcgttagattaggtagttggtggggtaatggcctaccaagcctacgatctatagctggtttaagaggatgatcagcaacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgtcccagagatgggtctttcacttcggtgaccgagtgacaggtgctgcatggctgtcgtcagctcgtgtcgtgagatgttcggttaagtccggcaacgagcgcaacccacacccttagttgccagcagttcggctgggcactctaagggaactgcccgtgataagcgggaggaaggtgtggatgacgtcaagtcctcatggcccttacgggttgggctacacacgtgctacaatggtagtgacaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaaccttttcgaagggggcagctggccacggtaagctcagcgactggggtgaagtcgtaacaaggtagccgtaggggaacctgcggctggatcacctcctttctaa

SEQ ID NO: 7367 - DNA, 1467 bp, Pseudooceanicola marinus
  ref <308>: DATABASE ACCESSION NUMBER: NCBI ACCESSION: NZ_FWFN01000016.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggtgagtaacgcgtgggaacgtacccagatctgcggaatagccactggaaacggtgagtaataccgcatacgcccttcgggggaaagatttatcggatttggatcggcccgcgttagattagatagttggtggggtaatggcctaccaagtctacgatctatagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggtatcaacaatgggttaatccctaaaagatatctcagttcggattggggtctgcaactcgaccccatgaagtcggaatcgctagtaatcgcgtaacagcatgacgcggtgaatacgttcccgggccttgtacacaccgcccgtcacatcatgggagttgggtttacccgaagacggtgcgccaacctttcgagggggcagctggccacggtaggctcagcgactgggatgaagtcgtaacaaggtagccgtaggggaacctgcggctggatcacctcctttctaa

SEQ ID NO: 7368 - DNA, 1471 bp, Pseudooceanicola nanhaiensis
  ref <308>: DATABASE ACCESSION NUMBER: NCBI ACCESSION: NZ_JHZF01000008.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgagaccttcgggtctagcggcggacgggtgagtaacgcgtgggaatgtgcccttctctacggaatagtcccgggaaactgggtttaataccgtatacgcccttcgggggaaagatttatcggagaaggatcagcccgcgtctgattaggtagttggtggggtaatggcctaccaagcctacgatcagtagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaaactctttcgccagggatgataatgacagtacctggtaaagaagccccggctaactccgtgccagcagccgcggtaatacggagggggctagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactccgagagatcggacgttcccttcggggacgcagtgacaggtgctgcatggctgtcgtcagctcgtgtcgtgagatgttcggttaagtccggcaacgagcgcaacccacacccttagttgccagcagttcggctgggcactctaagggaactgcccgtgataagcgggaggaaggtgtggatgacgtcaagtcctcatggcccttacgggttgggctacacacgtgctacaatggtatctacaatgggttaatcccaaaaagatatctcagttcggattgtcgtctgcaactcgacggcatgaagtcggaatcgctagtaatcgcgtaacagcatgacgcggtgaatacgttcccgggccttgtacacaccgcccgtcacatcatgggagttgggtttacccgaagacggtgcgccaaccagttcgctgggggcagctggccacggtaggctcaatgactgggatgaagtcgtaacaaggtagccgtaggggaacctgcggctggatcacctcctttctaa

SEQ ID NO: 7369 - DNA, 1466 bp, Pseudooctadecabacter jejudonensis
  ref <308>: DATABASE ACCESSION NUMBER: NCBI ACCESSION: NZ_FWFT01000009.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcacgcctaacacatgcaagtcgagcgctcacttcggtgggagcggcggacgggttagtaacgcgtgggaacatacccttttctacggaatagcctcgggaaactgagagtaataccgtatacgcccttcgggggaaagatttatcggtgaaggattggcccgcgttagattagatagttggtggggtaacggcctaccaagtctacgatctatagctggtttgagaggatgatcagcaacactgggactgagacacggcccagactcctacgggaggcagcagtggggaatcttagacaatgggggaaaccctgatctagcgatgccgcgtgtgtgacgaaggccttagggtcgtaaagcactttcgcctgtgatgataatgacagtagcaggtaaagaaaccccggctaactccgtgccagcagccgcggtaatacggaggggttagcgttgttcggaattactgggcgtaaagcgcacgtaggcggattattaagttaggggtgaaatcccggggctcaaccccggaactgcccttaatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagagggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 7370 - DNA, 1475 bp, Pseudopelagicola gijangensis
  ref <308>: DATABASE ACCESSION NUMBER: NCBI ACCESSION: NZ_FQZQ01000051.1
  ref <309>: DATABASE ENTRY DATE: 2019-04-01
  ref <313>: RELEVANT RESIDUES IN SEQ ID NO: (1)..(1475)
tcaacttgagagtttgatcctggctcagaacgaacgctggcggcaggcttaacacatgcaagtcgagcgcttcccttcggggaggagcggcggacgggttagtaacgcgtgggaacatacccttctctaaggaatagccactggaaacggtgagtaataccttatacgcccttcgggggaaagatttatcggagagggattggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcaccagggatgataatgacagtacctggaaaagaaaccccggctaactccgtgccagcagccgcggtaatacggagggggttagcgttgttcggaattactgggcgtaaagcgtacgtaggcggattagtaagttaggggtgaaatcccgaggctcaacctcggaactgcctctaaaactgctagtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagctaggctggacgagatacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacctcttcggaggaggcagcggaccacggtaggatcagcgactggggtgaagtcgtaacaaggtagccgtaggggaacctgcggctggatcacctcctttctaa

SEQ ID NO: 7371 - DNA, 1469 bp, Pseudophaeobacter arcticus
  ref <308>: DATABASE ACCESSION NUMBER: NCBI ACCESSION: NZ_KI421507.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttgtaaactcctgatcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggcccgccagagagatctggttttctcgcaagagaccaagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcaacaatgggttaatcccaaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgccaacctttcgagggggcagcggaccacggtgggttcagcgactggggtgaagtcgtaacaaggtagccgtaggggaacctgcggctggatcacctcctttctaa

SEQ ID NO: 7372 - DNA, 1467 bp, Pseudophaeobacter leonis
  ref <308>: DATABASE ACCESSION NUMBER: NCBI ACCESSION: NZ_MWVJ01000089.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagcctcgggaaactgagaggaataccttatacgccattcgggggaaagatttatcggagaaggatcggcccgcgttagattagatagttggtggggtaatggcctaccaagtctacgatctatagctggttttagaggatgatcagcaacactgggactgagagagggcccagactcctacgggaggcagcagtggggaatcttggacaatggccgcaagcctgatccagccatgccgcgtgagtgatgaaggccttagggtgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttataaactcctggtcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagacgtcagcaagcatgcttgttggtgtcaacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgccagagagatctggttttctcgcaagagaccaagtgacaggtgctgcatggctgtcgtcagctcgtgtcgtgagatgttcggttaaggccggcaacgagcgcaacctacatccttagttgccagcagttcggctgggcactctagggaaactgcccgtgataagcgggaggaaggtgtagatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacacatgacgcggtgaatacgttcccgggccttgtacacaccgcccgtcacaccatgggagttggatctacccgaaggccgtgcgccaaccttttcggagggggcagcggaccacggtgggttcagcgactggggtgaagtcgtaacaaggtagccgtagggaacctgcggctggatcacctcctttctaa

SEQ ID NO: 7373 - DNA, 1465 bp, Pseudophaeobacter sp. EL27
  ref <308>: DATABASE ACCESSION NUMBER: NCBI ACCESSION: NZ_OMPQ01000016.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagcctctggaaacggagagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttgtaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgctagagagatctagctttctcgcaagagaccaagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcatcaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgctaacttttgaggcagcggaccacggtgggttcagcgactggggtgaagtcgtaacaaggtagccgtaggggaacctgcggctggatcacctcctttctaa

SEQ ID NO: 7374 - DNA, 1535 bp, Pseudopropionibacterium propionicum
  ref <308>: DATABASE ACCESSION NUMBER: NCBI ACCESSION: NZ_LR134535.1
  ref <309>: DATABASE ENTRY DATE: 2019-04-01
  ref <313>: RELEVANT RESIDUES IN SEQ ID NO: (1)..(1535)
ttttcgatggagagtttgatcctggctcaggacgaacgctggcggtgtgcttaacacatgcaagtcgaacggtaaggccctttcgggggtacacgagtggcgaacgggtgagtaacacgtgagtaacctgccctcatctctgggataacagtcggaaacggttgctaatactggatatgagcttgcaaggcatcttgtgggttggaaagatttttttggttggggatggactcgcggcctatcagcttgttggtgaggtagtggctcaccaaggcttcgacgggtagccggcctgagagggcgaccggccacattgggactgagatacggcccaaactcctacgggaggcagcagtggggaatattgcacaatggacggaagtctgatgcagcaacgccgcgtgcgggaggacggccttcgggttgtaaaccgctttcaattgtgacgaagctttttgtgacggtagcagtagaagaagcaccggctaactacgtgccagcagccgcggtgatacgtagggtgcgagcgttgtccggatttattgggcgtaaagagcttgtaggcggtttgtcgcgtcgggagtgaaaacttggggcttaaccctgagcttgctttcgatacgggctgacttgagggaggtaggggagaatggaattcctggtggagcggtggaatgcgcagatatcaggaggaacaccggtggcgaaggcggttctctggacctttcctgacgctgagaagcgaaagcgtggggagcgaacaggcttagataccctggtagtccacgccgtaaacggtgggtactaggtgtgggggacattccacgttctccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatatgccggaagcgttcagagatgggcgtgcctttttggtcggtttacaggtggtgcatggctgtcgtcagctcgtgtcgtgagatgttgggttaagtcccgcaacgagcgcaaccctcgtccaatgttgccagcgggttatgccggggactcattggagaccgccggggtcaactcggaggaaggtggggatgacgtcaagtcatcatgccccttatgtccagggcttcacgcatgctacaatggccggtacaaagagctgcgagcctgtgagggtgagcgaatctcggaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaacccgtttttgggggggagccgtcgaaggtgggactggtgattaggactaagtcgtaacaaggtagccgtaccggaaggtgcggctggatcacctcctttctaaggag

SEQ ID NO: 7375 - DNA, 1102 bp, Pseudoramibacter alactolyticus
  ref <308>: DATABASE ACCESSION NUMBER: NCBI ACCESSION: NZ_GL622363.1
  ref <309>: DATABASE ENTRY DATE: 2019-04-01
  ref <313>: RELEVANT RESIDUES IN SEQ ID NO: (1)..(1102)
ttttacttgagagtttgatcctggctcaggacgaacgctggcggtatgcttaacacatgcaagtcgaacgagaagttttttattgacccttcgggggatataagagacagacagtggcgaacgggtgagtaacgcgtgggcaacctacctatcggagcgggatagcctcgagaaatcgggagtaaaaccgcataacacagcagaatcgcatgactttgctgtcaaaactccggtgccgatagatgggcccgcgtctgattagctagttggtaaggtaagggcttaccaaggcaacgatcagtagccggtctgagagggcgaacggccacactggaactgagacacggtccagactcctacgggaggcagcagtggggaatattgcgcaatgggggcaaccctgacgcagcaataccgcgtgagtgaagaaggttttcggatcgtaaagctctgttattggggaagaagcagtgacggtacccaatgaggaagtcccggctaactacgtgccagcagccgcggtaatacgtaggggacgagcgttgtccggaatcactgggcgtaaagggcgcgtaggcggttttataagtcagatgtgaaaggtaccggctcaaccggtgacgtgcatttgaaactgtaagacttgagtactgaagaggcaagcggaattcctagtgtagcggtgaaatgcgtagatattaggaagaacaccggtggcgaaggcggcttgctgggcagatactgacgctgaggtgcgaaagcgtggggagcgaacaggattagataccctggtagtccacgccgtaaacgatgaatactaggtgttggcgaataagtcagtgccggagttaacacaataagtattccgcctggggagtacgaccgcaaggttgaaactcaaaggaattgacggggacccgcacaagcagcggagcatgtggtttaattcgaagcaacgcgaagaaccttaccaggccttgacatcctctgagcgcaatagagatattgctttcccttcggagacagagagacaggtggtgcatggttgtcgtcagctcgtgtcgtgagatgttgggttaagtcccgcaacgagcgcaacccc

SEQ ID NO: 7376 - DNA, 1557 bp, Pseudorhizobium pelagicum
  misc_feature (1182)..(1182): n is a, c, g, or t
  misc_feature (1252)..(1252): n is a, c, g, or t
  misc_feature (1256)..(1256): n is a, c, g, or t
  misc_feature (1303)..(1303): n is a, c, g, or t
  ref <308>: DATABASE ACCESSION NUMBER: NCBI ACCESSION: NZ_JOKJ01000064.1
  ref <309>: DATABASE ENTRY DATE: 2019-04-01
  ref <313>: RELEVANT RESIDUES IN SEQ ID NO: (1)..(1557)
tttggagagtttgatcctggctcaggacgaacgctggcggcgtgcctaatacatgcaagtcgagcggaccggatcagggcttgctctggtttggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgaatgttagccgtcgggcagtttactgttcggtggcgccgctaacgctttaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctacggagacgtagggttcccttcggggaccgggacacaggtgctgcatggctgtcgtcagctcgtgtcgtgagatgttgggttaagtcccgcaacgagcgcaaccctygccyytagttgccagcattcagktgggcactctarrgggactgccggygayaagycgngaggaaggtggggatgacgtcaartcmtcatgscccttaygrsctgggctacacacgtgctacaatggknggtnacarwgggcwgcgaassmgcgaksssgagckaatcycmaaaagccrntctcagttcggattgcaskctgcaactcgmstgcatgaagyyggaatcgctagtaatcgcggatcagcaygccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaa

SEQ ID NO: 7377 - DNA, 1485 bp, Pseudorhodobacter antarcticus
  ref <308>: DATABASE ACCESSION NUMBER: NCBI ACCESSION: NZ_FOCO01000083.1
  ref <309>: DATABASE ENTRY DATE: 2019-04-01
  ref <313>: RELEVANT RESIDUES IN SEQ ID NO: (1)..(1485)
caacttgagagtttgatcctggctcagaatgaacgctggcggcaggcctaacacatgcaagtcgaacgagaccttcgggtctagtggcggacgggtgagtaacgcgtgggaacataccctttggtacggaatagcctcgggaaactgggagtaataccgtatgtgtcctttagctgtagtggttagaggagaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggattgacaagtcagaggtgaaatcccagggctcaaccttggaactgcctttgaaactgtcagtcttgagttcgagagaggtaagtggaattccgagtgtagaggtgaaattcgtagatattcggaggaacaccagtggcgaaggcggcttactggctcgatactgacgctgaggtgcgaaagcgtggggagcaaacaggattagataccctggtagtccacgccgtaaacgatgaatgccagtcgtcagcaagtatacttgttggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcggctcaggagactgagctttcagttcggctggatatcacacaggtgctgcatggctgtcgtcagctcgtgtcgtgagatgttcggttaagtccggcaacgagcgcaacccacatttttagttgccagcattcagttgggcactctagaaaaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacctggtaacaggaggcaggcggccacggtaggatcagcgactggggtgaagtcgtaacaaggtagccgtaggggaacctgcggctggatcacctcctttcta

SEQ ID NO: 7378 - DNA, 1469 bp, Pseudorhodobacter aquimaris
  ref <308>: DATABASE ACCESSION NUMBER: NCBI ACCESSION: NZ_LGHS01000052.1
  ref <309>: DATABASE ENTRY DATE: 2019-04-01
  ref <313>: RELEVANT RESIDUES IN SEQ ID NO: (1)..(1469)
caacttgagagtttgatcctggctcagaatgaacgctggcggcaggcctaacacatgcaagtcgaacgaaaccttcgggtttagtggcggacgggtgagtaacgcgtgggaacatacccaaaggtacggaatagtctcgggaaactgggggtaataccgtatgtgcccttcgggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgattgatgaaggccttcgggttgtaaagatctttcagatgggaagataatgacggtaccatcagaagaagccccggctaactccgtgccagcagccgcggtaatacggagggggctagcgttattcggaattactgggcgtaaagcgcacgtaggcgggtcggcaagttaggggtgaaatcccggggctcaaccccggaacggcccttaaaactgctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcgggaccagagatggttctttcagttcggctggatatcacacaggtgctgcatggctgtcgtcagctcgtgtcgtgagatgttcggttaagtccggcaacgagcgcaacccacatttttagttgccatcatttagttgggcactctagaaaaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgccaacccttacgggaggcagcggaccacggtaggatcagcgactggggtgaagtcgtaacaaggtagccgtaggggaacctgcggctggatcacctcctttctaa

SEQ ID NO: 7379 - DNA, 1483 bp, Pseudorhodobacter ferrugineus
  ref <308>: DATABASE ACCESSION NUMBER: NCBI ACCESSION: NZ_LGHV01000002.1
  ref <309>: DATABASE ENTRY DATE: 2019-04-01
  ref <313>: RELEVANT RESIDUES IN SEQ ID NO: (1)..(1483)
caacttgagagtttgatcctggctcagaatgaacgctggcggcaggcctaacacatgcaagtcgaacgaagccttcgggcttagtggcggacgggtgagtaacgcgtgggaacatacccaaaggtacggaatagcctcgggaaactgggagtaataccgtatgtgccctttcactgtagtggtgggaggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggattagcaagtcagaggtgaaatcccagggctcaaccttggaacggcctttgaaactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcagcaagtatacttgttggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcggacctggagacaggtctttcagttcggctggatatcacacaggtgctgcatggctgtcgtcagctcgtgtcgtgagatgttcggttaagtccggcaacgagcgcaacccacatttttagttgccagcattcagttgggcactctagaaaaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccgtaagggaggcaggcggccacggtaggatcagcgactggggtgaagtcgtaacaaggtagccgtaggggaacctgcggctggatcacctcctttcta

SEQ ID NO: 7380 - DNA, 1468 bp, Pseudorhodobacter psychrotolerans
  ref <308>: DATABASE ACCESSION NUMBER: NCBI ACCESSION: NZ_LGIC01000003.1
  ref <309>: DATABASE ENTRY DATE: 2019-04-01
  ref <313>: RELEVANT RESIDUES IN SEQ ID NO: (1)..(1468)
caacttgagagtttgatcctggctcagaatgaacgctggcggcaggcctaacacatgcaagtcgaacgggtccttcgggactagtggcggacgggtgagtaacgcgtgggaacataccctttggtacggaatagcctcgggaaactgagagtaataccgtatgtgcccttcgggggaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggattagaaagtcagaggtgaaatcccagggctcaaccttggaactgcctttgaaactcctagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcggctctggagacagagctttcagttcggctggatatcacacaggtgctgcatggctgtcgtcagctcgtgtcgtgagatgttcggttaagtccggcaacgagcgcaacccacatttttagttgccagcattcagttgggcactctagaaaaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattggatctacccgaaggtggtgcgccaaccagcaatggaggcagccaaccacggtaggttcagtgactggggtgaagtcgtaacaaggtagccgtaggggaacctgcggctggatcacctcctttcta

SEQ ID NO: 7381 - DNA, 1469 bp, Pseudorhodobacter sp. E13
  ref <308>: DATABASE ACCESSION NUMBER: NCBI ACCESSION: NZ_RPEN01000116.1
  ref <309>: DATABASE ENTRY DATE: 2019-04-01
  ref <313>: RELEVANT RESIDUES IN SEQ ID NO: (1)..(1469)
caacttgagagtttgatcctggctcagaatgaacgctggcggcaggcctaacacatgcaagtcgaacgaagccttcgggcttagtggcggacgggtgagtaacgcgtgggaacatacccaaaggtacggaatagcctcgggaaactgggagtaataccgtatgtgcccttcgggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggatcagaaagtcagaggtgaaatcccagggctcaaccttggaactgcctttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagcaagtatacttgttggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcgggaccagagatggttctttcagttcggctggatatcacacaggtgctgcatggctgtcgtcagctcgtgtcgtgagatgttcggttaagtccggcaacgagcgcaacccacactcttagttgccagcattcagttgggcactctaggagaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttacgggaggcaggcggccacggtaggatcagcgactggggtgaagtcgtaacaaggtagccgtaggggaacctgcggctggatcacctcctttctaa

SEQ ID NO: 7382 - DNA, 1471 bp, Pseudorhodobacter sp. MZDSW-24AT
  ref <308>: DATABASE ACCESSION NUMBER: NCBI ACCESSION: NZ_PGOI01000017.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgaacgaagccttcgggcttagtggcggacgggtgagtaacgcgtgggaacgtgccctttggtacggaatagccctgggaaactgggagtaataccgtatgtgcccttcgggggaaagatttatcgccaaaggatcggcccgcgttggattaggtagttggtggggtaatggcccaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggactggaaagtcagaggtgaaatcccagggctcaaccttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacactttcagttgccatcatttggttgggcactctggaagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgtaggggaacctgcggctggatcacctcctttctaa

SEQ ID NO: 7383 - DNA, 1470 bp, Pseudorhodobacter wandonensis
  ref <308>: DATABASE ACCESSION NUMBER: NCBI ACCESSION: NZ_LGHT01000002.1
  ref <309>: DATABASE ENTRY DATE: 2019-04-01
  ref <313>: RELEVANT RESIDUES IN SEQ ID NO: (1)..(1470)
caacttgagagtttgatcctggctcagaatgaacgctggcggcaggcctaacacatgcaagtcgaacgaagccttcgggcttagtggcggacgggtgagtaacgcgtgggaacataccctttggtacggaatagcctcgggaaactgggagtaataccgtatgtgcccttcgggggaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggattagcaagtcagaggtgaaatcccagggctcaaccttggaactgcctttgaaactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagcaagtatacttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcggctctggagacagagctttcagttcggctggatatcacacaggtgctgcatggctgtcgtcagctcgtgtcgtgagatgttcggttaagtccggcaacgagcgcaacccacactcttagttgccagcattcagttgggcactctaagagaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacctagcaataggaggcaggcggccacggtaggatcagcgactggggtgaagtcgtaacaaggtagccgtaggggaacctgcggctggatcacctcctttcta

SEQ ID NO: 7384 - DNA, 1491 bp, Pseudorhodoplanes sinuspersici
  ref <308>: DATABASE ACCESSION NUMBER: NCBI ACCESSION: NZ_RAQD01000004.1
  ref <309>: DATABASE ENTRY DATE: 2019-04-01
  ref <313>: RELEVANT RESIDUES IN SEQ ID NO: (1)..(1491)
caacttgagagtttgatcctggctcagagcgaacgctggcggcaggcttaacacatgcaagtcgagcgccccgcaaggggagcggcagacgggagagtaacacgtgggaacgtacctttcagttcggaacaaccaagggaaactttggctaataccgaatacgcccgtaaggggaaagatttatcgctgaaagatcggcccgcgtctgattagctagttggtggggtaatggcccaccaaggcgacgatcagtagctggtctgagaggatgatcagcctcactgggactgagacacggcccagactcctacgggaggcagcagtggggaatattggacaatgggcgaaagcctgatccagccatgccgcgtgagtgatgaaggccttagggttgtaaagctctttcgtcagggaagataatgacggtacctgaagaagaagccccggctaacttcgtgccagcagccgcggtaatacgaagggggctagcgttgctcggaatcactgggcgtaaagcgcacgtaggcggctttctaagtcaggggtgaaatcctggagctcaactccagaactgcctttgatactggagagcttgagttcgagagaggtgagtggaactgcgagtgtagaggtgaaattcgtagatattcgcaagaacaccagtggcgaaggcggctcactggctcgatactgacgctgaggtgcgaaagcgtggggagcaaacaggattagataccctggtagtccacgccgtaaacgatggatgctagccgttggacagcttgctgttcagtggcgcagctaacgcattaagcatcccgcctggggagtacggtcgcaagattaaaactcaaaggaattgacgggggcccgcacaagcggtggagcatgtggtttaattcgaagcaacgcgcagaaccttaccaacccttgacatgtccagtatgggtaccagagatggaacccttcagttcggctggctggaacacaggtgctgcatggctgtcgtcagctcgtgtcgtgagatgttgggttaagtcccgcaacgagcgcaaccctcgcccttagttgccatcatttagttgggcactctagggggactgccggtgataagccgcgaggaaggtggggatgacgtcaagtcctcatggcccttacgggttgggccacacacgtgctacaatggcggtgacaatgggatgcaaaggcgcaagcccgtgcaaatctcaaaaagccgtctcagttcggactggggtctgcaactcgaccccacgaagtcggaatcgctagtaatcgtggatcagcatgccacggtgaatacgttcccgggccttgtacacaccgcccgtcacaccatgggagttggctttacctgaaggcgctgcgctaacccgcaagggaggcaggcgaccacggtagggtcagcgactggggtgaagtcgtaacaaggtagccgtaggggaacctgcggctggatcacctcctttctaa

SEQ ID NO: 7385 - DNA, 1467 bp, Pseudoroseicyclus aestuarii
  ref <308>: DATABASE ACCESSION NUMBER: NCBI ACCESSION: NZ_QJTE01000017.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgagaccttcgggtctagcggcggacgggtgagtaacgcgtgggaacgtgcccttcactgcggaatagtcccgggaaactgggtttaataccgcatacgcccttcgggggaaagatttatcggtgaaggatcggcccgcgttagattaggtagttggtggggtaatggcctaccaagccgacgatctatagctggtttgagaggatgatcagccacactgggactgagacacggcccagactcctacgggaggcagcagtggggaatcttagacaatgggggcaaccctgatctagccatgccgcgtgtgtgatgaaggccttagggtcgtaaagcactttcgctggggaagataatgactgtacccagtaaagaaaccccggctaactccgtgccagcagccgcggtaatacggagggggttagcgttgttcggaattactgggcgtaaagcgcgcgtaggcggattacccagtcagaggtgaaatcccggggctcaaccccggaacggcctttgatactagtagtcttgagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgtcgcagagatgcgtctttctcgtaagagaccgagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggtatctacagtgggttaatccccaaaagatatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgacgacggtgcgctaacccttcggggaggcagccggccacggtaggctcagcgactggggtgaagtcgtaacaaggtagccgtaggggaacctgcggctggatcacctcctttctaa

SEQ ID NO: 7386 - DNA, 1470 bp, Pseudoruegeria aquimaris
  ref <308>: DATABASE ACCESSION NUMBER: NCBI ACCESSION: NZ_FWFQ01000052.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcgcccttcggggtgagcggcggacgggttagtaacgcgtgggaacgtacccaaaggtagggaatagccactggaaacggtgagtaataccctatgtgcccttcgggggaaagatttatcgcctttggatcggcccgcgttagattaggtagttggtggggtaatggcctaccaagcctacgatctatagctggtttgagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 7387 - DNA, 1474 bp, Pseudoruegeria haliotis
  ref <308>: DATABASE ACCESSION NUMBER: NCBI ACCESSION: NZ_PVTD01000027.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgcttcccttcggggaggagcggcggacgggttagtaacgcgtgggaatatgcccaaaggtagggaatagccactggaaacggtgagtaataccctatgtgcccttcgggggaaagatttatcgcctttggattagcccgcgttggattaggtagttggtggggtaatggcctaccaagcctacgatccatagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactattaagtcgagggtgaaatcccagggctcaaccctggaactgccttcgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacctgtcgcggcatccagagatggatgccttcagttcggctggacaggatacaggtgctgcatggctgtcgtcagctcgtgtcgtgagatgttcggttaagtccggcaacgagcgcaacccacgtctttagttgccagcagttcggctgggcactctaaagaaactgccggtgataagccggaggaaggtgtggatgacgtcaagtcctcatggcccttacgggttgggctacacacgtgctacaatggtagtgacaatgggttaatcccaaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacccttacggggggcagctggccacggtaggctcagcgactggggtgaagtcgtaacaaggtagccgtaggggaacctgcggctggatcacctcctttctaa

SEQ ID NO: 7388 - DNA, 1472 bp, Pseudoruegeria marinistellae
  ref <308>: DATABASE ACCESSION NUMBER: NCBI ACCESSION: NZ_LNCI01000028.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgcactcttcggagtgagcggcggacgggttagtaacgcgtgggaatatgcccaaaggtagggaatagcctctggaaacggagagtaataccctatgtgcccttcgggggaaagatttatcgcctttggattagcccgcgttggattaggtagttggtggggtaacggcctaccaagccgacgatccatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacgtccttagttgccagcagttcggctgggcactctaaggaaactgccggtgataagccggaggaaggtgtggatgacgtcaagtcctcatggcccttacgggttgggctacacacgtgctacaatggtagtgacaatgggttaatccccaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacctgcaaagggggcagctggccacggtaggctcagcgactggggtgaagtcgtaacaaggtagccgtaggggaacctgcggctggatcacctcctttctaa

SEQ ID NO: 7389 - DNA, 1474 bp, Pseudoruegeria sabulilitoris
  ref <308>: DATABASE ACCESSION NUMBER: NCBI ACCESSION: NZ_LOAS01000080.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgcactcttcggagtgagcggcggacgggttagtaacgcgtgggaatatgcccaaaggtagggaatagccactggaaacggtgagtaataccctatgtgcccttcgggggaaagatttatcgcctttggattagcccgcgttggattaggtagttggtggggtaatggcctaccaagcctacgatccatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacgtccttagttgccagcagttcggctgggcactctaaggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaaccttttcgaagggggcagctggccacggtaggctcagcgactggggtgaagtcgtaacaaggtagccgtaggggaacctgcggctggatcacctcctttctaa

SEQ ID NO: 7390 - DNA, 1470 bp, Pseudoruegeria sp. SK021
  ref <308>: DATABASE ACCESSION NUMBER: NCBI ACCESSION: NZ_MTBG01000072.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcactcttcggagtgagcggcggacgggttagtaacgcgtgggaatatgcccaatggtacggaatagcctctggaaacggagagtaataccgtatgtgcccttcgggggaaagatttatcgccattggattagcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcacgtaggcggatcgaaaagttgggggtgaaatcccagggctcaaccctggaactgcctccaaaactctcggtcttgagttcgagagaggtaagtggaattccgagtgtagaggtgaaattcgtagatattcggaggaacaccagtggcgaaggcgacttactggctcgatactgacgctgaggtgcgaaagtgtggggagcaaacaggattagataccctggtagtccacaccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagggatcgcggttatccgagaggatttccttcagttcggctggatcccatacaggtgctgcatggctgtcgtcagctcgtgtcgtgagatgttcggttaagtccggcaacgagcgcaacccacgtctttagttgccagcaggttaagctgggcactctaaagaaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaaccttcggggggcaggcggccacggtaggatcagcgactggggtgaagtcgtaacaaggtagccgtaggggaacctgcggctggatcacctcctttcta

SEQ ID NO: 7391 - DNA, 1533 bp, Pseudoscardovia suis
  ref <308>: DATABASE ACCESSION NUMBER: NCBI ACCESSION: NZ_PGFC01000016.1
  ref <309>: DATABASE ENTRY DATE: 2019-04-01
  ref <313>: RELEVANT RESIDUES IN SEQ ID NO: (1)..(1533)
tttcgtggagggtttgattctggctcaggacgaacgctggcggcgtgcttaacacatgcaagtcgaacgggatcccgcgggctttgcttgcgggtgagagtggcgaacgggtgagtaatgcgtgaccaacctgccccattctccggaatagctcctggaaacgggtggtaatgccggatgctccgccccctcgcatggggggtcgggaaggcttttgcggaatgggatggggtcgcgtcctatcagcttgttggcggggcgacggcccaccaaggcttcgacgggtagccggcctgagagggcgaccggccacattgggactgagatacggcccagactcctacgggaggcagcagtggggaatattgcacaatggggggaaccctgatgcagcgacgccgcgtgcgggatggaggccttcgggtcgtgaaccgcttttgattgggagcaagcgtgagtgagtgtacctttcgaataagcaccggctaactacgtgccagcagccgcggtaatacgtagggtgcaagcgttgtccggaatcattgggcgtaaagggctcgtaggcggttcgtcgcgtccggtgtgaaagcccatcgcttaacggtgggtctgcgccgggtacgggcgggcttgagtgcggcaggggaggctggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcccgttccgcgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttaccaaggcttgacatgtgcctggcggccgcggagacgcggcttcccttcggggcgggctcacaggtggtgcatggtcgtcgtcagctcgtgtcgtgagatgttgggttaagtcccgcaacgagcgcaaccctcgccgcgtgttgccagcgggtagtgccggggactcgcgcgggaccgccggggttaactcggaggaaggtggggatgacgtcagatcatcatgccccttacgtcttgggcttcacgcatgctacaatggccggcacagcggggtgcgatgccgtgaggcggagcggatccctgaaagccggtctcagttcggatcggagcctgcaacccggctccgtgaaggtggagtcgctagtaatcgcggatcagcaacgccgcggtgaatgcgttcccgggccttgtacacaccgcccgtcaagtcatgaaagtcggcagcacccgaagccggtggcctgacccttgtggggggagccgtctaaggtgaggctggtgattgggactaagtcgtaacaaggtagccgtaccggaaggtgcggctggatcacctcctttctatggag

SEQ ID NO: 7392 - DNA, 1491 bp, Pseudovibrio axinellae
  ref <308>: DATABASE ACCESSION NUMBER: NCBI ACCESSION: NZ_FOFM01000046.1
  ref <309>: DATABASE ENTRY DATE: 2019-04-01
  ref <313>: RELEVANT RESIDUES IN SEQ ID NO: (1)..(1491)
aaacctgagagtttgatcctggctcagaacgaacgctggcggcaggcctaacacatgcaagtcgaacgattccttcgggaatagtggcagacgggtgagtaacgcgtgggaaattaccttatggtagggaacaacagttggaaacgactgctaataccctatgtgccctacgggggaaagatttatcgccataagatgtgcccgcgttagattagctagttggtgaggtaagagctcaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactaataagttaggggtgaaatcccaaggctcaaccttggaactgcctttaatactgttagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacatcgggagaccgatggttcccttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgtaaggggggcaggcgaccacggtagggtcagcgactggggtgaagtcgtaacaaggtagccctaggggaacctggggctggatcacctcctttctaagga

SEQ ID NO: 7393 - DNA, 1489 bp, Pseudovibrio denitrificans
  ref <308>: DATABASE ACCESSION NUMBER: NCBI ACCESSION: NZ_FPBD01000019.1
  ref <309>: DATABASE ENTRY DATE: 2019-04-01
  ref <313>: RELEVANT RESIDUES IN SEQ ID NO: (1)..(1489)
caacctgagagtttgatcctggctcagaacgaacgctggcggcaggcctaacacatgcaagtcgaacggatccttcgggattagtggcagacgggtgagtaacgcgtgggaagctaccttgtggtagggaacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgagtgatgacggccttagggttgtaaagctctttcagcagtgaagataatgacattaactgcagaagaagccccggctaacttcgtgccagcagccgcggtaatacgaagggggctagcgttgttcggaatcactgggcgtaaagcgtacgtaggcggactgatcagtcaggggtgaaatcccggggctcaaccccggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttggcgctacaaccggagacggttggttcccttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggaagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccctaggggaacctggggctggatcacctcctttctaagga

SEQ ID NO: 7394 - DNA, 1499 bp, Pseudovibrio hongkongensis
  ref <308>: DATABASE ACCESSION NUMBER: NCBI ACCESSION: NZ_LLWC01000011.1
  ref <309>: DATABASE ENTRY DATE: 2019-04-01
  ref <313>: RELEVANT RESIDUES IN SEQ ID NO: (1)..(1499)
ttttagttgaacctgagagtttgatcctggctcagaacgaacgctggcggcaggcctaacacatgcaagtcgaacggatccttcgggattagtggcagacgggtgagtaacgcgtgggaagctaccttttggtagggaacaacagttggaaacgactgctaataccctatacgccctttgggggaaagatttatcgccgaaagatgtgcccgcgttagattagctagttggtggggtaatggcccaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagggaagataatgacattatctgcagaagaagccccggctaacttcgtgccagcagccgcggtaatacgaagggggctagcgttgttcggaatcactgggcgtaaagcgcgcgtaggcggattgataagttaggggtgaaatcccgaggctcaacctcggaactgcctttgatactgtcagtctagagatcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatggaagctagttgtcaggcagcatgctgtttggtgacgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttaacgctacacagagagatttgtggttctcttcggagacgttaggacaggtgctgcatggctgtcgtcagctcgtgtcgtgagatgttgggttaagtcccgcaacgagcgcaaccctcgcccttagttgccatcattcagttgggcactctagggggactgccggtgataagccggaggaaggtggggatgacgtcaagtcctcatggcccttacgggctgggctacacacgtgctacaatggcggtgacagtgggcagcgacctcgcgaggggaagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgtaagggaggcaggcgaccacggtagggtcagcgactggggtgaagtcgtaacaaggtagccctaggggaacctggggctggatcacctcctttctaagga

SEQ ID NO: 7395 - DNA, 1486 bp, Pseudovibrio sp. AU243
  ref <308>: DATABASE ACCESSION NUMBER: NCBI ACCESSION: NZ_OMPG01000014.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcctaacacatgcaagtcgaacggatccttcgggattagtggcagacgggtgagtaacgcgtgggaagctaccttgtggtaggggacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacaaccggagacggttggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttcta

SEQ ID NO: 7396 - DNA, 1491 bp, Pseudovibrio sp. Ab134
  ref <308>: DATABASE ACCESSION NUMBER: NCBI ACCESSION: NZ_MIEL01000037.1
  ref <309>: DATABASE ENTRY DATE: 2019-04-01
  ref <313>: RELEVANT RESIDUES IN SEQ ID NO: (1)..(1491)
ttaaacctgagagtttgatcctggctcagaacgaacgctggcggcaggcctaacacatgcaagtcgaacggatccttcgggattagtggcagacgggtgagtaacgcgtgggaagctaccttgtggtagggaacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagcgtacgtaggcggactgatcagtcaggggtgaaatcccggggctcaaccccggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttggcgctacatcgggagaccgatggttcccttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgagaggaagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccctaggggaacctggggctggatcacctcctttctaagga

SEQ ID NO: 7397 - DNA, 1491 bp, Pseudovibrio sp. Ad13
  ref <308>: DATABASE ACCESSION NUMBER: NCBI ACCESSION: NZ_LMCC01000026.1
  ref <309>: DATABASE ENTRY DATE: 2019-04-01
  ref <313>: RELEVANT RESIDUES IN SEQ ID NO: (1)..(1491)
caacctgagagtttgatcctggctcagaacgaacgctggcggcaggcctaacacatgcaagtcgaacggatccttcgggattagtggcagacgggtgagtaacgcgtgggaagctaccttgtggtaggggacaacagtttgaaaagactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctagaaccggagacggttggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7398 - DNA, 1491 bp, Pseudovibrio sp. Ad14
  ref <308>: DATABASE ACCESSION NUMBER: NCBI ACCESSION: NZ_LMCD01000046.1
  ref <309>: DATABASE ENTRY DATE: 2019-04-01
  ref <313>: RELEVANT RESIDUES IN SEQ ID NO: (1)..(1491)
caacctgagagtttgatcctggctcagaacgaacgctggcggcaggcctaacacatgcaagtcgaacggatccttcgggattagtggcagacgggtgagtaacgcgtgggaagctaccttgtggtaggggacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacatctggagacagatggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7399 - DNA, 1491 bp, Pseudovibrio sp. Ad26
  ref <308>: DATABASE ACCESSION NUMBER: NCBI ACCESSION: NZ_LMCE01000078.1
  ref <309>: DATABASE ENTRY DATE: 2019-04-01
  ref <313>: RELEVANT RESIDUES IN SEQ ID NO: (1)..(1491)
aaacctgagagtttgatcctggctcagaacgaacgctggcggcaggcctaacacatgcaagtcgaacggatccttcgggattagtggcagacgggtgagtaacgcgtgggaagctaccttgtggtaggggacaacagtttgaaaagactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacatctggagacagatggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7400 - DNA, 1490 bp, Pseudovibrio sp. Ad37
  ref <308>: DATABASE ACCESSION NUMBER: NCBI ACCESSION: NZ_LMCF01000097.1
  ref <309>: DATABASE ENTRY DATE: 2019-04-01
  ref <313>: RELEVANT RESIDUES IN SEQ ID NO: (1)..(1490)
aacctgagagtttgatcctggctcagaacgaacgctggcggcaggcctaacacatgcaagtcgaacggatccttcgggattagtggcagacgggtgagtaacgcgtgggaagctaccttgtggtaggggacaacagtttgaaaagactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctagatcgggagaccgattgttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7401 - DNA, 1491 bp, Pseudovibrio sp. Ad46
  ref <308>: DATABASE ACCESSION NUMBER: NCBI ACCESSION: NZ_LMCG01000014.1
  ref <309>: DATABASE ENTRY DATE: 2019-04-01
  ref <313>: RELEVANT RESIDUES IN SEQ ID NO: (1)..(1491)
gaacctgagagtttgatcctggctcagaacgaacgctggcggcaggcctaacacatgcaagtcgaacggatccttcgggattagtggcagacgggtgagtaacgcgtgggaagctaccttgtggtaggggacaacagtttgaaaagactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacaaccggagacggttggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7402 - DNA, 1491 bp, Pseudovibrio sp. Ad5; identical to SEQ ID NO: 7401
  ref <308>: DATABASE ACCESSION NUMBER: NCBI ACCESSION: NZ_LMCH01000062.1
  ref <309>: DATABASE ENTRY DATE: 2019-04-01
  ref <313>: RELEVANT RESIDUES IN SEQ ID NO: (1)..(1491)

SEQ ID NO: 7403 - DNA, 1486 bp, Pseudovibrio sp. Alg231-02
  ref <308>: DATABASE ACCESSION NUMBER: NCBI ACCESSION: NZ_FREX01000009.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcctaacacatgcaagtcgaacggatccttcgggattagtggcagacgggtgagtaacgcgtgggaagctaccttgtggtaggggacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacatcgggagaccgatggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttcta

SEQ ID NO: 7404 - DNA, 1489 bp, Pseudovibrio sp. FO-BEG1
  ref <308>: DATABASE ACCESSION NUMBER: NCBI ACCESSION: NC_016642.1
  ref <309>: DATABASE ENTRY DATE: 2019-04-01
  ref <313>: RELEVANT RESIDUES IN SEQ ID NO: (1)..(1489)
gaacctgagagtttgatcctggctcagaacgaacgctggcggcaggcctaacacatgcaagtcgaacggatccttcgggattagtggcagacgggtgagtaacgcgtgggaagctaccttgtggtagggaacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgagtgatgacggccttagggttgtaaagctctttcagcagtgaagataatgacattaactgcagaagaagccccggctaacttcgtgccagcagccgcggtaatacgaagggggctagcgttgttcggaatcactgggcgtaaagcgtacgtaggcggactgatcagtcaggggtgaaatcccggggctcaaccccggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttggcgctacaaccggagacggttggttcccttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggaagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccctaggggaacctggggctggatcacctcctttctaagga

SEQ ID NO: 7405 - DNA, 1489 bp, Pseudovibrio sp. JE062; identical to SEQ ID NO: 7404
  ref <308>: DATABASE ACCESSION NUMBER: NCBI ACCESSION: NZ_DS996819.1
  ref <309>: DATABASE ENTRY DATE: 2019-04-01
  ref <313>: RELEVANT RESIDUES IN SEQ ID NO: (1)..(1489)

SEQ ID NO: 7406 - DNA, 1491 bp, Pseudovibrio sp. POLY-S9
  ref <308>: DATABASE ACCESSION NUMBER: NCBI ACCESSION: NZ_LCWX01000129.1
  ref <309>: DATABASE ENTRY DATE: 2019-04-01
  ref <313>: RELEVANT RESIDUES IN SEQ ID NO: (1)..(1491)
caacctgagagtttgatcctggctcagaacgaacgctggcggcaggcctaacacatgcaagtcgaacggatccttcgggattagtggcagacgggtgagtaacgcgtgggaagctaccttgtggtaggggacaacagttggaaacgactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacaaccggagacggttggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7407 - DNA, 1489 bp, Pseudovibrio sp. Tun.PSC04-5.I4
  ref <308>: DATABASE ACCESSION NUMBER: NCBI ACCESSION: NZ_FNLB01000006.1
  ref <309>: DATABASE ENTRY DATE: 2019-04-01
  ref <313>: RELEVANT RESIDUES IN SEQ ID NO: (1)..(1489)
caacctgagagtttgatcctggctcagaacgaacgctggcggcaggcctaacacatgcaagtcgaacgaattcttcggaattagtggcagacgggtgagtaacgcgtgggaaattaccttatggtagggaacaacagttggaaacgactgctaataccctatgtgccctacgggggaaagatttatcgccataagatgtgcccgcgttggattagctagttggtaaggtaatggcttaccaaggcgacgatccatagctggtctgagaggatgatcagccacactgggactgagacacggcccagactcctacgggaggcagcagtggggaatattggacaatgggcgcaagcctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagcgtacgtaggcggactgataagttaggggtgaaatcccaaggctcaaccttggaactgcctttaatactgttagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctatatcgggagaccgatagttctcttcggagacgtcaggacaggtgctgcatggctgtcgtcagctcgtgtcgtgagatgttgggttaagtcccgcaacgagcgcaaccctcgcccttagttgccagcattaagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttctacccgaaggcgctgcgctaacctagcaatagggggcaggcgaccacggtagggtcagcgactggggtgaagtcgtaacaaggtagccctaggggaacctggggctggatcacctcctttcta

SEQ ID NO: 7408 - DNA, 1491 bp, Pseudovibrio sp. W64; identical to SEQ ID NO: 7406
  ref <308>: DATABASE ACCESSION NUMBER: NCBI ACCESSION: NZ_LMCI01000038.1
  ref <309>: DATABASE ENTRY DATE: 2019-04-01
  ref <313>: RELEVANT RESIDUES IN SEQ ID NO: (1)..(1491)

SEQ ID NO: 7409 - DNA, 1491 bp, Pseudovibrio sp. W74; identical to SEQ ID NO: 7398
  ref <308>: DATABASE ACCESSION NUMBER: NCBI ACCESSION: NZ_LMCJ01000017.1
  ref <309>: DATABASE ENTRY DATE: 2019-04-01
  ref <313>: RELEVANT RESIDUES IN SEQ ID NO: (1)..(1491)

SEQ ID NO: 7410 - DNA, 1490 bp, Pseudovibrio sp. WM33
  ref <308>: DATABASE ACCESSION NUMBER: NCBI ACCESSION: NZ_LMCK01000055.1
  ref <309>: DATABASE ENTRY DATE: 2019-04-01
  ref <313>: RELEVANT RESIDUES IN SEQ ID NO: (1)..(1490)
aacctgagagtttgatcctggctcagaacgaacgctggcggcaggcctaacacatgcaagtcgaacggatccttcgggattagtggcagacgggtgagtaacgcgtgggaagctaccttgtggtaggggacaacagtttgaaaagactgctaataccctatgagccctatgggggaaagatttatcgccatgagatgtgcccgcgttagattagctagttggtaaggtaatggcttaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagtgaagataatgacattaactgcagaagaagccccggctaacttcgtgccagcagccgcggtaatacgaagggggctagcgttgttcggaatcactgggcgtaaagagtacgtaggcggactgataagttaggggtgaaatcccaaggctcaaccttggaactgcctttgatactgtcagtcttgagatcgagagaggtgagtggaactccgagtgtagaggtgaaattcgtagatattcggaagaacaccagtggcgaaggcggctcactggctcgatactgacgctgaggtacgaaagcgtggggagcaaacaggattagataccctggtagtccacgccgtaaacgatgaatgctagttgtcaggtagcttgctatttggtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatttgacgctacatcgggagaccgatggttcctttcggggacgtcaggacaggtgctgcatggctgtcgtcagctcgtgtcgtgagatgttgggttaagtcccgcaacgagcgcaaccctcgcccttagttgccagcatttagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctctaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7411 - DNA, 1491 bp, Pseudovibrio stylochi
  ref <308>: DATABASE ACCESSION NUMBER: NCBI ACCESSION: NZ_LLWE01000026.1
  ref <309>: DATABASE ENTRY DATE: 2019-04-01
  ref <313>: RELEVANT RESIDUES IN SEQ ID NO: (1)..(1491)
caacctgagagtttgatcctggctcagaacgaacgctggcggcaggcctaacacatgcaagtcgaacgatcttttcggagatagtggcagacgggtgagtaacgcgtgggaagctaccttttggtagggaacaacagttggaaacgactgctaataccctatacgccctttgggggaaagatttatcgccgaaagatgtgcccgcgttagattagctagttggtggggtaatggcctaccaaggcgacgatctatagctggtctgagaggatgatcagccacactgggactgagacacggcccagactcctacgggaggcagcagtggggaatattggacaatgggggcaaccctgatccagccatgccgcgtgtgtgatgacggccttagggttgtaaagcactttcagcagagaagataatgacattatctgcagaagaagccccggctaacttcgtgccagcagccgcggtaatacgaagggggctagcgttgttcggaatcactgggcgtaaagcgcacgtaggcggattgataagttaggggtgaaatcccgaggctcaacctcggaactgcctttgatactgtcagtctagagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatggaagctagttgtcaggcagtatactgtttggtgacgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttaacgctacacagagagatttgtggttctcttcggagacgttaggacaggtgctgcatggctgtcgtcagctcgtgtcgtgagatgttgggttaagtcccgcaacgagcgcaaccctcgcccttagttgccatcattaagttgggcactctagggggactgccggtgataagccggaggaaggtggggatgacgtcaagtcctcatggcccttacgggctgggctacacacgtgctacaatggcggtgacagtgggcagcgacctcgcgaggggtagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccctaggggaacctggggctggatcacctcctttctaagga

SEQ ID NO: 7412 - DNA, 1142 bp, Pseudoxanthobacter soli
  ref <308>: DATABASE ACCESSION NUMBER: NCBI ACCESSION: NZ_FRXO01000020.1
  ref <309>: DATABASE ENTRY DATE: 2019-04-01
  ref <313>: RELEVANT RESIDUES IN SEQ ID NO: (1)..(1142)
aagcctgatccagccatgccgcgtgagtgatgaaggccttagggttgtaaagctctttcacctgggaagataatgacggtaccaggagaagaagccccggctaacttcgtgccagcagccgcggtaatacgaagggggctagcgttgttcggaatcactgggcgtaaagcgcacgtaggcggattgataagtcaggggtgaaatcccgaggctcaacctcggaactgcctttgatactgttagtcttgagttcgggagaggtgagtggaactccgagtgtagaggtgaaattcgtagatattcggaagaacaccagtggcgaaggcggctcactggcccgatactgacgctgaggtgcgaaagcgtggggagcaaacaggattagataccctggtagtccacgccgtaaacgatggaagccagccgttgggtagcttgctattcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagctcttgacatggcaggacggtattcggagacggatatcttcacttcggtgacctgcacacaggtgctgcatggctgtcgtcagctcgtgtcgtgagatgttgggttaagtcccgcaacgagcgcaaccctcgcccttagttgccatcattcagttgggcactctagggggactgccggtgataagccgagaggaaggtggggatgacgtcaagtcctcatggcccttacgggctgggctacacacgtgctacaatggcggtgacaatggggagcgaccctgcgaggggtagccaatcccaaaaagccgtctcagttcggattgtactctgcaactcgagtgcatgaagtcggaatcgctagtaatcgcagatcagcatgctgcggtgaatacgttcccgggccttgtacacaccgcccgtcacaccatgggagttggttctacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 7413 - DNA, 1547 bp, Pseudoxanthomonas sp. CF385
  ref <308>: DATABASE ACCESSION NUMBER: NCBI ACCESSION: NZ_FNKZ01000001.1
  ref <309>: DATABASE ENTRY DATE: 2019-04-01
  ref <313>: RELEVANT RESIDUES IN SEQ ID NO: (1)..(1547)
tttaagtgaagagtttgatcctggctcagagtgaacgctggcggtaggcctaacacatgcaagtcgaacggcagcacaggagagcttgctctctgggtggcgagtggcggacgggtgaggaatacatcggaatctaccttttcgtgggggataacgtagggaaacttacgctaataccgcatacgacctacgggtgaaagtgggggaccgcaaggcctcacgcgattagatgagccgatgtccgattagctagttggcggggtaatggcccaccaaggcgacgatcggtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatcctatcggttaataaccggtggggatgacggtacccaaagaataagcaccggctaacttcgtgccagcagccgcggtaatacgaagggtgcaagcgttactcggaattactgggcgtaaagcgtgcgtaggtggtggtttaagtccgttgtgaaagccctgggctcaacctgggaattgcagtggatactggatcactagagtgtggtagagggatgcggaatttctggtgtagcagtgaaatgcgtagagatcagaaggaacatccgtggcgaaggcggcatcctgggccaacactgacactgaggcacgaaagcgtggggagcaaacaggattagataccctggtagtccacgccctaaacgatgcgaactggatgttgggtgcaacttggcacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaaacccgcgagggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 7414 - DNA, 1545 bp, Pseudoxanthomonas sp. GM95
  ref <308>: DATABASE ACCESSION NUMBER: NCBI ACCESSION: NZ_FOAX01000008.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacagagaagcttgcttcttgggtggcgagtggcggacgggtgaggaatacatcggaatctactctttcgtgggggataacgtagggaaacttacgctaataccgcatacgcccttcgggggaaagccggggaccttcgggcctggcgcgattgaatgagccgatgtcggattagcttgttggtgaggtaatggctcaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcattcggttaatacccgggtgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatagtggaatttccggtgtagcagtgaaatgcgtagagatcggaaggaacatctgtggcgaaggcgactatctgggccaacactgacactgaggcacgaaagcgtggggagcaaacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccgcaaggagggcgcttgccacggtgtggccgatgactggggtgaagtcgtaacaaggtagccgtatcggaaggtgcggctggatcacctccttt

SEQ ID NO: 7415 - DNA, 1545 bp, Pseudoxanthomonas sp. GSS15
  ref <308>: DATABASE ACCESSION NUMBER: NCBI ACCESSION: NZ_SAWZ01000021.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacagaggagcttgctccttgggtggcgagtggcggacgggtgaggaatacatcggaatctactctttcgtgggggataacgtagggaaacttacgctaataccgcatacgaccttcgggtgaaagcaggggatcgcaagaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcacacggttaatacccgagtgttctgacggtacccaaagaataagcaccggctaacttcgtgccagcagccgcggtaatacgaagggtgcaagcgttactcggaattactgggcgtaaagcgtgcgtaggtggtgatttaagtccgttgtgaaagccctgggctcaacctgggaattgcagtggatactgggtcactagagtgtggtagaggatagtggaatttccggtgtagcagtgaaatgcgtagagatcggaaggaacatctgtggcgaaggcgactatctgggccaacactgacactgaggcacgaaagcgtggggagcaaacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtggggacagagggctgcaaactcgcgagagtgagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 7416 - DNA, 1545 bp, Pseudoxanthomonas sp. KAs 5 3
  ref <308>: DATABASE ACCESSION NUMBER: NCBI ACCESSION: NZ_PKSO01000004.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctaccttttcgtgggggataacgtagggaaacttacgctaataccgcatacgacctacgggtgaaagtgggggaccgcaaggcctcacgcgattagatgagccgatgtccgattagctagttggcggggtaatggcccaccaaggcgacgatcggtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatcctatcggttaataaccggtggggatgacggtacccaaagaataagcaccggctaacttcgtgccagcagccgcggtaatacgaagggtgcaagcgttactcggaattactgggcgtaaagcgtgcgtaggtggtggtttaagtccgttgtgaaagccctgggctcaacctgggaattgcagtggatactggatcactagagtgtggtagagggatgcggaatttctggtgtagcagtgaaatgcgtagagatcagaaggaacatccgtggcgaaggcggcatcctgggccaacactgacactgaggcacgaaagcgtggggagcaaacaggattagataccctggtagtccacgccctaaacgatgcgaactggatgttgggtgcaacttggcacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaaacccgcgagggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 7417 - DNA, 1547 bp, Pseudoxanthomonas sp. SGD-10
  ref <308>: DATABASE ACCESSION NUMBER: NCBI ACCESSION: NZ_RRYL01000018.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcgggtagggagcttgctccctatgccggcgagtggcggacgggtgaggaatacatcggaatctactctgtcgtgggggataacgtagggaaacttacgctaataccgcatacgacctacgggtgaaagtgggggaccgcaaggcctcacgcgatagaatgagccgatgtccgattagctagttggcggggtaaaggcccaccaaggcgacgatcggtagctggtctgagaggatgatcagccacactgggactgagacacggcccagactcctacgggaggcagcagtggggaatattggacaatgggcgcaagcctgatccagccataccgcgtgagtgaagaaggccctcgggttgtaaagctcttttgttgggaaagaaatcctgttggctaatacccggcagggatgacggtacccaaagaataagcaccggctaacttcgtgccagcagccgcggtaatacgaagggtgcaagcgttactcggaattactgggcgtaaagcgtgcgtaggtggtggtttaagtctgttgtgaaagccctgggctcaacctgggaattgcagtggatactggatcactagagtgtggtagagggtggcggaattcccggtgtagcagtgaaatgcgtagagatcgggaggaacacccgtggcgaaggcggccacctgggccaacactgacactgaggcacgaaagcgtggggagcaaacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtggggacagagggctgcgatcccgcgagggtgagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccgcaaggagggcgcttgccacggtgtggccgatgactggggtgaagtcgtaacaaggtagccgtatcggaaggtgcggctggatcacctccttt

SEQ ID NO: 7418 - DNA, 1547 bp, Pseudoxanthomonas sp. SGD-5-1; identical to SEQ ID NO: 7417
  ref <308>: DATABASE ACCESSION NUMBER: NCBI ACCESSION: NZ_RRYM01000166.1
  ref <309>: DATABASE ENTRY DATE: 2019-04-01
  ref <313>: RELEVANT RESIDUES IN SEQ ID NO: (1)..(1547)

SEQ ID NO: 7419 - DNA, 1547 bp, Pseudoxanthomonas sp. YR558; identical to SEQ ID NO: 7413
  ref <308>: DATABASE ACCESSION NUMBER: NCBI ACCESSION: NZ_FPCI01000001.1
  ref <309>: DATABASE ENTRY DATE: 2019-04-01
  ref <313>: RELEVANT RESIDUES IN SEQ ID NO: (1)..(1547)

SEQ ID NO: 7420 - DNA, 1549 bp, Pseudoxanthomonas spadix
  ref <308>: DATABASE ACCESSION NUMBER: NCBI ACCESSION: NZ_RDQN01000022.1
  ref <309>: DATABASE ENTRY DATE: 2019-04-01
  ref <313>: RELEVANT RESIDUES IN SEQ ID NO: (1)..(1549)
taagtgaagagtttgatcctggctcagagtgaacgctggcggtaggcctaacacatgcaagtcgaacggcagcacagtaggagcttgctcttacgggtggcgagtggcggacgggtgaggaatacatcggaatctaccttttggtgggggataacgtagggaaacttacgctaataccgcatacgcccttcgggggaaagccggggaccagcaatggcctggcgctgatagatgagccgatgtcggattagctagttggtgaggtaatggctcaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcattcggttaatacccgggtgttctgacggtacccaaagaataagcaccggctaacttcgtgccagcagccgcggtaatacgaagggtgcaagcgttactcggaattactgggcgtaaagcgtgcgtaggtggtggtttaagtccgttgtgaaagccctgggctcaacctgggaattgcagtggatactggatcactagagtgtggtagaggatagtggaatttccggtgtagcagtgaaatgcgtagagatcggaaggaacatctgtggcgaaggcgactatctgggccaacactgacactgaggcacgaaagcgtggggagcaaacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaaaggtgggaactctaaggagaccgccggtgacaaaccggaggaaggtggggatgacgtcaagtcatcatggcccttacgaccagggctacacacgtactacaatggtcaggacagagggctgcaagccggcgacggtgagccaatcccagaaacctgatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccgcaaggagggcgcttgccacggtgtggccgatgactggggtgaagtcgtaacaaggtagccgtatcggaaggtgcggctggatcacctccttt

SEQ ID NO: 7421 - DNA, 1545 bp, Pseudoxanthomonas wuyuanensis
  ref <308>: DATABASE ACCESSION NUMBER: NCBI ACCESSION: NZ_OCND01000005.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctacctagtcgtgggggataacgtagggaaacttacgctaataccgcatacgacctacgggtgaaagtgggggaccttcgggcctcacgcgattagatgagccgatgtcggattagctagttggaggggtaatggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatcctattgattaatactcggtggggatgacggtacccaaagaataagcaccggctaacttcgtgccagcagccgcggtaatacgaagggtgcaagcgttactcggaattactgggcgtaaagcgtgcgtaggtggttgtttaagtctgctgtgaaagccctgggctcaacctgggaattgcagtggatactgggcgactagagtgtggtagaggatagtggaatttccggtgtagcagtgaaatgcgtagagatcggaaggaacatctgtggcgaaggcgactatctgggccaacactgacactgaggcacgaaagcgtggggagcaaacaggattagataccctggtagtccacgccctaaacgatgcgaactggatgttgggtgcaacttggcacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtgaggacagagggctgcaaacccgcgagggcaagccaatcccagaaacctcatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 7422 - DNA, 1531 bp, Pseudozobellia sp. CCMM003
  ref <308>: DATABASE ACCESSION NUMBER: NCBI ACCESSION: NZ_RBCJ01000009.1
  ref <309>: DATABASE ENTRY DATE: 2019-04-01
  ref <313>: RELEVANT RESIDUES IN SEQ ID NO: (1)..(1531)
acgatgaagagtttgatcctggctcaggatgaacgctagcggcaggcctaacacatgcaagtcgaggggcagcatttccagcttgctggaagatggcgaccggcgcacgggtgcgcaacgcgtatggaacctgcccgctgcaggggaatagcccggggaaacccggattaatgccccgtggtaccgttacacggcatcgtgtaccggttagagcctacgggcggcagcggatggccatgcgtaccattagctggttggtaaggtaacggcttaccaaagctacgatggttaggggccctgagagggggatcccccacactggtactgagacacggaccagactcctacgggaggcagcagtgaggaatattggacaatgggcggaggcctgatccagccatgccgcgtgcgggaagacggccctacgggtcgtaaaccgcttttgtacgggaagaaacctctccacgtgtggagagttgacggtaccgtaagaataaggaccggctaactccgtgccagcagccgcggtaatacggagggtccgagcgttatccggaatcattgggtttaaagggtccgtaggcgggccgttaagtcaggggtgaaataccacggctcaaccgtggaggtgcccttgatactggcggtcttgagttacagtggagcggccggaatatgtggtgtagcggtgaaatgcatagatatcacatagaacaccgatcgcgaaggcaggtcgctaactgtatactgacgctgatggacgaaagcgtggggagcgaacgggattagataccccggtagtccacgccgtaaacgatggacactagctgtcgggccctcgggctcggcggccaagcgaaagtgataagtgtcccacctggggagtacgttcgcaagaatgaaactcaaaggaattgacgggggcccgcacaagcggtggagcatgtggtttaattcgatgatacgcgaggaaccttaccagggcttaaatgcataatgacaggggtagagatacccttttcttcggacattttgcaaggtgctgcatggttgtcgtcagctcgtgccgtgaggtgtcaggttaagtcctataacgagcgcaacccctgccgttagttgccagcatgtaaagatggggactctaacgggactgccggtgcaaaccgcgaggaaggtggggacgacgtcaaatcatcacggcccttacgtcctgggccacacacgtgctacaatggccggtacagcgggaagccaccccgtaagggggcgcggatccacaaaaccggtcacagttcggatcggggtctgcaacccgaccccgtgaagctggaatcgctagtaatcggatatcagccatgatccggtgaatacgttcccgggccttgtacacaccgcccgtcaagccatggaagccgggagtgcctgaagtccgtcaccgcgaggagcggcctagggcaagatcggtaactagggctaagtcgtaacaaggtagccgtaccggaaggtgcggctggaacacctcctttctgga

SEQ ID NO: 7423 - DNA, 1527 bp, Psychrilyobacter atlanticus
  ref <308>: DATABASE ACCESSION NUMBER: NCBI ACCESSION: NZ_KE384548.1
  ref <309>: DATABASE ENTRY DATE: 2019-04-01
  ref <313>: RELEVANT RESIDUES IN SEQ ID NO: (1)..(1527)
ttgaatgtagagtttgatcctggctcaggatgaacgctgacagaatgcttaacacatgcaagtcgactggaattcttcttcggaagatagtacggtggcggacgggtgagtaacgcgtaaagaatttgcccttcagaccgggacaactaatcgaaaggttagctaataccggatattatgagaccttggcatcaaggacttatgaaagctatatgcgctggaggagaactttgcgttccattaggtagttggtagggtaatggcctaccaagccgacgatggatagccggcctgagagggtgaacggccacaaggggactgagacacggcccttactcctacgggaggcagcagtggggaatattggacaatggaccaaaagtctgatccagcaattctgtgtgcacgatgaaggtcttcggattgtaaagtgctttcaggtgggaagaagaaagtgacggtaccaccagaagaagcgacggctaaatacgtgccagcagccgcggtaatacgtatgtcgcaagcgttatccggaattattgggcgtaaagcgagtctaggcggcttgttaagtcagatgtgaaaatgcggggctcaactccgtattgcgtttgaaactggcaggctagagtactggagaggtgggcggaactacaagtgtagaggtgaaattcgtagatatttgtaggaatgccgatagtgaagacagctcactggacagatactgacgctaaagctcgaaagcgtggggagcgaacaggattagataccctggtagtccacgccgtaaacgatgttcactgggtgtagggggtcgaacctctgtgccgaagctaacgcgataagtgaaccgcctggggagtacgcacgcaagtgtgaaactcaaaggaattgacggggacccgcacaagcggtggagcatgtggtttaattcgacgcaacgcgaggaaccttaccagcacttgacatacaacgaactcgtcagagatgacttggtgccgcttcggtggaacgttgatacaggtggtgcatggctgtcgtcagctcgtgtcgtgagatgttgggttaagtcccgcaacgagcgcaacccctatcgtatgttaccatcattaagttggggactcatgcgagactgcctgcgacgagcaggaggaaggtggggatgacgtcaagtcatcatgccccttatgtgctgggctacacacgtgctacaatggttggtacagagagcagcaataccgcgaggtggagcaaatctcagaaagccaatcttagttcggatcgcagtctgcaactcgactgcgtgaagttggaatcgctagtaatcgcgaatcagcaatgtcgcggtgaatacgttctcgggtcttgtacacaccgcccgtcacaccacgagagttggttgcacctaaagtagcaggcctaacctttatggagggatgttcctaaggtgtgattagcgattggggtgaagtcgtaacaaggtatccgtaccggaaggtgcggatggatcacctcctttctaaggag

SEQ ID NO: 7424 - DNA, 1425 bp, Psychrilyobacter sp. SD5
  ref <308>: DATABASE ACCESSION NUMBER: NCBI ACCESSION: NZ_QUAJ01000070.1
  ref <309>: DATABASE ENTRY DATE: 2019-04-01
  ref <313>: RELEVANT RESIDUES IN SEQ ID NO: (1)..(1425)
ttgaatgtagagtttgatcctggctcaggatgaacgctgacagaatgcttaacacatgcaagtcgactggaattcttcttcggaagatagtacggtggcggacgggtgagtaacgcgtaaagaatttgcccttcagactgggacaactaatcgaaaggttagctaataccggatattatgagacctcggcatcgaggacttatgaaagctatatgcgctggaggagaactttgcgttccattagctagttggtagggtaatggcctaccaaggcgacgatggatagccggcctgagagggtgaacggccacaaggggactgagacacggcccttactcctacgggaggcagcagtggggaatattggacaatggaccaaaagtctgatccagcaattctgtgtgcacgatgaaggtcttcggattgtaaagtgctttcaggtgggaagaagaaagtgacggtaccaccagaagaagcgacggctaaatacgtgccagcagccgcggtaatacgtatgtcgcaagcgttatccggaattattgggcgtaaagcgagtctaggcggcttgttaagtcagatgtgaaaatgcggggctcaactccgtattgcgtttgaaactggcaggctagagtactggagaggtgggcggaactacaagtgtagaggtgaaattcgtagatatttgtaggaatgccgatagtgaagacagctcactggacagatactgacgctaaagctcgaaagcgtggggagcgaacaggattagataccctggtagtccacgccgtaaacgatgttcactgggtgtagggggtcgaacctctgtgccgaagctaacgcgataagtgaaccgcctggggagtacgcacgcaagtgtgaaactcaaaggaattgacggggacccgcacaagcggtggagcatgtggtttaattcgacgcaacgcgaggaaccttaccagcacttgacatacaacgaactcgtcagagatgacttggtgccgcttcggtggaacgttgatacaggtggtgcatggctgtcgtcagctcgtgtcgtgagatgttgggttaagtcccgcaacgagcgcaacccctatcgtatgttaccatcattaagttggggactcatgcgagactgcctgcgacgagcaggaggaaggtggggatgacgtcaagtcatcatgccccttatgtgctgggctacacacgtgctacaatggttggtacagagagcagcaatacggcgacgtggagcaaatctcagaaagccaatcttagttcggatcgcagtctgcaactcgactgcgtgaagttggaatcgctagtaatcgcgaatcagcaatgtcgcggtgaatacgttctcgggtcttgtacacaccgcccgtcacaccacgagagttggttgcacctaaagtagcaggcctaacc

SEQ ID NO: 7425 - DNA, 1556 bp, Psychrobacillus insolitus
  ref <308>: DATABASE ACCESSION NUMBER: NCBI ACCESSION: NZ_QKZI01000029.1
  ref <309>: DATABASE ENTRY DATE: 2019-04-01
  ref <313>: RELEVANT RESIDUES IN SEQ ID NO: (1)..(1556)
attatggagagtttgatcctggctcaggacgaacgctggcggcatgcctaatacatgcaagtcgagcgaatgatgaagaagcttgcttcttctgatttagcggcggacgggtgagtaacacgtgggcaacctgccctgtagattgggataactccgggaaaccggggctaataccgaataatccatttcctctcatggggaaatgttaaaagacggtttcggctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccactgaccggtctagagatagatctttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagctaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttct

SEQ ID NO: 7426 - DNA, 1557 bp, Psychrobacillus psychrodurans
  ref <308>: DATABASE ACCESSION NUMBER: NCBI ACCESSION: NZ_FOUN01000042.1
  ref <309>: DATABASE ENTRY DATE: 2019-04-01
  ref <313>: RELEVANT RESIDUES IN SEQ ID NO: (1)..(1557)
ttatggagagtttgatcctggctcaggacgaacgctggcggcatgcctaatacatgcaagtcgagcgaatgacgaagaagcttgcttcttctgatttagcggcggacgggtgagtaacacgtgggcaacctgccctgtagattgggataactccgggaaaccggggctaataccgaataatccatttcctcacatggggagatgttaaaagacggcatctcgctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccggcctagagataggcttttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagcaaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 7427 - DNA, 1337 bp, Psychrobacillus psychrotolerans
  ref <308>: DATABASE ACCESSION NUMBER: NCBI ACCESSION: NZ_FOXU01000016.1
  ref <309>: DATABASE ENTRY DATE: 2019-04-01
  ref <313>: RELEVANT RESIDUES IN SEQ ID NO: (1)..(1337)
gctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccggcctagagataggcttttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagcaaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 7428 - DNA, 1567 bp, Psychrobacillus sp. FJAT-21963
  misc_feature (1175)..(1175): n is a, c, g, or t
  ref <308>: DATABASE ACCESSION NUMBER: NCBI ACCESSION: NZ_LJIY01000004.1
  ref <309>: DATABASE ENTRY DATE: 2019-04-01
  ref <313>: RELEVANT RESIDUES IN SEQ ID NO: (1)..(1567)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgangactgccggtgataaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 7429 - DNA, 1559 bp, Psychrobacillus sp. OK028
  ref <308>: DATABASE ACCESSION NUMBER: NCBI ACCESSION: NZ_FNHY01000019.1
  ref <309>: DATABASE ENTRY DATE: 2019-04-01
  ref <313>: RELEVANT RESIDUES IN SEQ ID NO: (1)..(1559)
ctattatggagagtttgatcctggctcaggacgaacgctggcggcatgcctaatacatgcaagtcgagcgaatgacgaagaagcttgcttcttctgatttagcggcggacgggtgagtaacacgtgggcaacctgccctgtagattgggataactccgggaaaccggggctaataccgaataatccatttcctcacatgtggaaatgttaaaagacggtttcggctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccggtctagagatagacttttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagcaaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttcta

SEQ ID NO: 7430 - DNA, 1337 bp, Psychrobacillus sp. OK032
  ref <308>: DATABASE ACCESSION NUMBER: NCBI ACCESSION: NZ_FOGY01000038.1
  ref <309>: DATABASE ENTRY DATE: 2019-04-01
  ref <313>: RELEVANT RESIDUES IN SEQ ID NO: (1)..(1337)
gctgtcactacaggatgggcccgcggcgcattagctagttggtggggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggaaggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctctagagatagagttttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagctaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 7431 - DNA, 1546 bp, Psychrobacter immobilis
  ref <308>: DATABASE ACCESSION NUMBER: NCBI ACCESSION: NZ_OAES01000110.1
  ref <309>: DATABASE ENTRY DATE: 2019-04-01
  ref <313>: RELEVANT RESIDUES IN SEQ ID NO: (1)..(1546)
attgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttct

SEQ ID NO: 7432 - DNA, 1587 bp, Psychrobacter sp. DAB AL32B
  ref <308>: DATABASE ACCESSION NUMBER: NCBI ACCESSION: NZ_NEXU01000130.1
  ref <309>: DATABASE ENTRY DATE: 2019-04-01
  ref <313>: RELEVANT RESIDUES IN SEQ ID NO: (1)..(1587)
gatgagccaagtttagtagcctctttaaagggttacatagcaagattaaactgaagagtttgatcatggctcagattgaacgctggcggcaggcttaacacatgcaagtcgagcggtaacatttctagcttgctagaagatgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggctcaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccggattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggaaggcgttcaccacggtgtggttgatgactggggtgaagtcgtaacaaggtagccgtaggggaacctgcggctggatcacctccttat

SEQ ID NO: 7433 - DNA, 1582 bp, Psychrobacter sp. FDAARGOS 221
  ref <308>: DATABASE ACCESSION NUMBER: NCBI ACCESSION: NZ_NWFK02000001.1
  ref <309>: DATABASE ENTRY DATE: 2019-04-01
  ref <313>: RELEVANT RESIDUES IN SEQ ID NO: (1)..(1582)
atgagccaagtttagaagcttctttaaagagcttcatagcaagattaaactgaagagtttgatcatggctcagattgaacgctggcggcaggcttaacacatgcaagtcgagcggaaacgatgggagcttgctcccaggcgtcgagcggcggacgggtgagtaatacttaggaatctgcccagtagtgggggatagctcggggaaactcgaattaataccgcatacaccctacggggaaaagggggcgcttgcgctctcgctattggatgagcctaagtcggattagctagttggtggggtaaaggcctaccaaggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagacctagtggttaatacccattagcgatgacattagctgcagaataagcaccggctaactctgtgccagcagccgcggtaatacagagggtgcaagcgttaatcggaattactgggcgtaaagcgagcgtaggtggtttgataagtcagatgtgaaatccccgggcttaacctgggaactgcatctgatactgtcaggctagagtaggtgagagggaggtagaatttcaggtgtagcggtgaaatgcgtagagatctgaaggaataccgatggcgaaggcagcctcctggcatcatactgacactgaggttcgaaagcgtgggtagcaaacaggattagataccctggtagtccacgccgtaaacgatgtctactagtcgttgggggacttgatcccttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttttccttagttaccagcggtttggccggggactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagttgattgcaccagaagtgggtagcctaacttttagagggcgctcaccacggtgtggtcgatgactggggtgaagtcgtaacaaggtagccgtaggggaacctgcggctggatcacctccttaa

SEQ ID NO: 7434 - DNA, 1155 bp, Pueribacillus theae
  ref <308>: DATABASE ACCESSION NUMBER: NCBI ACCESSION: NZ_QCZG01000098.1
  ref <309>: DATABASE ENTRY DATE: 2019-04-01
  ref <313>: RELEVANT RESIDUES IN SEQ ID NO: (1)..(1155)
ggagcaacgccgcgtgagtgaagaaggttttcggatcgtaaagctctgttgtgagggaagaacaagtaagggagtcactgcccttgccatgacggtacctcaccagaaagccacggctaactacgtgccagcagccgcggtaatacgtaggtggcaagcgttgtccggaattattgggcgtaaagcgcgcgcaggcggtcctttaagtctgatgtgaaatcttgcggcttaaccgcaagcggtcattggaaactgggggacttgagtacagaagaggagagtggaattccacgtgtagcggtgaaatgcgtagagatgtggaggaacaccagtggcgaaggcggctctctggtctgtcactgacgctgaggcgcgaaagcgtgggtagcgaacaggattagataccctggtagtccacgccgtaaacgatgagtgctaggtgttgggggtttccaccctcagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctggccgtcctagagatagggcttttccttcggggacagcggagacaggtggtgcatggttgtcgtcagctcgtgtcgtgagatgttgggttaagtcccgcaacgagcgcaacccttgagattagttgccagcattgagttgggcactctaatatgactgccgcagacaatgcggaggaaggtggggatgacgtcaaatcatcatgccccttatgacctgggctacacacgtgctacaatggatggtacaacgggcagcgaagccgcgaggtggagcgaatcccaaaaagccattctcagttcggattgcaggctgcaactcgcctgcatgaagtcggaatcgctagtaatcgcggatcagcatgccgcggtgaatacgttcccgggccttgtacacaccgcccgtcacaccacgagagtttgtaacacccgaagtcggtggggtaaccgtaaggagccagccgccgaaggtgggacagatgattggggtgaagtcgtaacaaggtagccgtatcggaaggtgcggctggatcacctcctttcta

SEQ ID NO: 7435 - DNA, 1471 bp, Puniceibacterium antarcticum
  ref <308>: DATABASE ACCESSION NUMBER: NCBI ACCESSION: NZ_AWWI01000078.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgctcacttcggtgggagcggcggacgggttagtaacgcgtgggaacgtacccttttctatgggatagccttgggaaactgagagtaataccatatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcgcgtaggcggatcagaaagtatggggtgaaatcccggggctcaacctcggaactgcctcataaactactggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgctggagagattcagctttctcgtaagagaccaagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaacctcgcaagaggaggcagctggccacggtaagctcagcgactggggtgaagtcgtaacaaggtagccgtaggggaacctgcggctggatcacctcctttctaa

SEQ ID NO: 7436 - DNA, 1471 bp, Puniceibacterium sediminis
  ref <308>: DATABASE ACCESSION NUMBER: NCBI ACCESSION: NZ_FZNN01000046.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgaacggcaccttcgggtgtagtggcggacgggttagtaacgcgtgggaacgtacccttttctgcgggatagccttgggaaactgagagtaataccgcatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcgcgtaggcggattagaaagtatggggtgaaatcccggggctcaacctcggaactgcctcataaactactagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggatcgctggagagattcagctttctcgtaagagaccaagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaacctgttcgcaggaggcagctggccacggtaagctcagcgactggggtgaagtcgtaacaaggtagccgtaggggaacctgcggctggatcacctcctttctaa

SEQ ID NO: 7437 - DNA, 1471 bp, Puniceibacterium sp. IMCC21224
  ref <308>: DATABASE ACCESSION NUMBER: NCBI ACCESSION: NZ_LDPY01000001.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgaacggcaccttcgggtgtagtggcggacgggttagtaacgcgtgggaacgtacccttttctacggaatagcctcgggaaactgagagtaataccgtataagcccttcgggggaaagatttatcgggaaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcgcgtaggcggattagaaagtatggggtgaaatcccggggctcaacctcggaactgcctcataaactactagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttctcgtaagagacctagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaacctgttcgcagggggcagctggccacggtaagctcagcgactggggtgaagtcgtaacaaggtagccgtaggggaacctgcggctggatcacctcctttctaa

SEQ ID NO: 7438 - DNA, 1543 bp, Pusillimonas caeni
  ref <308>: DATABASE ACCESSION NUMBER: NCBI ACCESSION: NZ_PDUW01000019.1
  ref <309>: DATABASE ENTRY DATE: 2019-04-01
  ref <313>: RELEVANT RESIDUES IN SEQ ID NO: (1)..(1543)
attgaactgaagagtttgatcctggctcagattgaacgctagcgggatgctttacacatgcaagtcgaacggcagcacgagataagcttgcttatcttggtggcgagtggcgaacgggtgagtaatgtatcggaacgtgcccagtagcgggggataactacgcgaaagcgtggctaataccgcatacgccctacgggggaaagggggggatcgcaagacctctcactattggagcggccgatatcggattagctagttggtggggtaaaggcctaccaaggctgcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggcgccggttaatacctggtgccgctgacggtacctgcagaataagcaccggctaactacgtgccagcagccgcggtaatacgtagggtgcaagcgttaatcggaattactgggcgtaaagcgtgcgtcggcggtttggcaagaaaggtgtgaaatcccagggcttaaccttggaactgcacttttaactgccaggctagagtatgtcagaggggggtagaattccacgtgtagcagtgaaatgcgtagagatgtggaggaataccgatggcgaaggcagccccctgggataatactgacgctcaggcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggtttcaccagaagtaggtagcctaaccgcaaggggggcgcttaccacggtgggattcatgactggggtgaagtcgtaacaaggtagccgtatcggaaggtgcggctggatcacctcctttc

SEQ ID NO: 7439 - DNA, 1545 bp, Pusillimonas ginsengisoli
  ref <308>: DATABASE ACCESSION NUMBER: NCBI ACCESSION: NZ_SDQE01000025.1
  ref <309>: DATABASE ENTRY DATE: 2019-04-01
  ref <313>: RELEVANT RESIDUES IN SEQ ID NO: (1)..(1545)
agattgaactgaagagtttgatcctggctcagattgaacgctagcgggatgctttacacatgcaagtcgaacggcagcgcgaggaaagcttgcttttcttggcggcgagtggcgaacgggtgagtaatatatcggaacgtgcccagtagcgggggataactacgcgaaagcgtggctaataccgcatacgccctacgggggaaagggggggatcgcaagacctctcactattggagcggccgatatcagattagctagttggtgaggtaaaggctcaccaaggccgcgatctgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggcgctggttaatacctggcgccgatgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactgccgggctagagtatgtcagaggggggtagaattccacgtgtagcagtgaaatgcgtagagatgtggaggaataccgatggcgaaggcagccccctgggataatactgacgctcatgcacgaaagcgtggggagcaaacaggattagataccctggtagtccacgccctaaacgatgtcaactagctgttgggggcttcggcccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaagcttcgagagattgaagtgtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 7440 - DNA, 1546 bp, Pusillimonas harenae
  ref <308>: DATABASE ACCESSION NUMBER: NCBI ACCESSION: NZ_SDQD01000007.1
  ref <309>: DATABASE ENTRY DATE: 2019-04-01
  ref <313>: RELEVANT RESIDUES IN SEQ ID NO: (1)..(1546)
gattaaactgaagagtttgatcctggctcagattgaacgctagcgggatgctttacacatgcaagtcgaacggcagcgcgagaaaagcttgcttttcttggcggcgagtggcgaacgggtgagtaatatatcggaacgtgcccagtagcgggggataactacgcgaaagcgtggctaataccgcatacgccctacgggggaaagggggggattcttcggaacctctcactattggagcggccgatatcagattagctagttggtgaggtaaaggctcaccaaggccgcgatctgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaacggcgctgaataatacttggcgtcactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactgccgagctagagtatgtcagaggggggtagaattccacgtgtagcagtgaaatgcgtagagatgtggaggaataccgatggcgaaggcagccccctgggataatactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaagctttaagagattaaagtgtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 7441 - DNA, 1545 bp, Pusillimonas noertemannii
  ref <308>: DATABASE ACCESSION NUMBER: NCBI ACCESSION: NZ_PDUX01000009.1
  ref <309>: DATABASE ENTRY DATE: 2019-04-01
  ref <313>: RELEVANT RESIDUES IN SEQ ID NO: (1)..(1545)
attgaactgaagagtttgatcctggctcagattgaacgctagcgggatgctttacacatgcaagtcgaacggcagcacgagataagcttgcttatcttggtggcgagtggcgaacgggtgagtaatgtatcggaacgtgcccagtagcgggggataactacgcgaaagcgtggctaataccgcatacgccctacgggggaaagagggggatccttcgggacctctcactattggagcggccgatatcggattagctagttggtggggtaaaggcctaccaaggctgcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggcgcgggttaataccttgcgccgctgacggtacctgcagaataagcaccggctaactacgtgccagcagccgcggtaatacgtagggtgcaagcgttaatcggaattactgggcgtaaagcgtgcgtaggcggtttggcaagaaagatgtgaaatcccagggcttaaccttggaactgcatttttaactgccaggctagagtatgtcagaggggggtagaattccgcgtgtagcagtgaaatgcgtagagatgcggaggaataccgatggcgaaggcagccccctgggataatactgacgctcaggcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggtttcaccagaagtaggtagcctaaccgtaaggggggcgcttaccacggtgggattcatgactggggtgaagtcgtaacaaggtagccgtatcggaaggtgcggctggatcacctcctttc

SEQ ID NO: 7442 - DNA, 1542 bp, Pusillimonas soli
  ref <308>: DATABASE ACCESSION NUMBER: NCBI ACCESSION: NZ_SDQC01000012.1
  ref <309>: DATABASE ENTRY DATE: 2019-04-01
  ref <313>: RELEVANT RESIDUES IN SEQ ID NO: (1)..(1542)
attgaactgaagagtttgatcctggctcagattgaacgctagcgggatgctttacacatgcaagtcgaacggcagcgcgaggaaagcttgcttttcttggcggcgagtggcgaacgggtgagtaatgtatcggaacgtgcccagtagcgggggataactacgcgaaagcgtggctaataccgcatacgccctacgggggaaagagggggatcgcaagacctctcactattggagcggccgatatcagattagctagttggtgaggtaaaggctcaccaaggctgcgatctgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaaaggtgccggttaatacctggcgccgctgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactgccgggctagagtatgtcagaggggggtagaattccacgtgtagcagtgaaatgcgtagagatgtggaggaataccgatggcgaaggcagccccctgggataatactgacgctcatgcacgaaagcgtgggtagcaaacaggattagataccctggtagtccacgccctaaacgatgtcaactagctgttgggggcttcggcccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaggccgaagagatttggctgtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcaagggggagccaatcccagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 7443 - DNA, 1542 bp, Pusillimonas sp. 17-4A
  ref <308>: DATABASE ACCESSION NUMBER: NCBI ACCESSION: NZ_NQOU01000015.1
  ref <309>: DATABASE ENTRY DATE: 2019-04-01
  ref <313>: RELEVANT RESIDUES IN SEQ ID NO: (1)..(1542)
attaaactgaagagtttgatcctggctcagattgaacgctagcgggatgctttacacatgcaagtcgaacggcagcacgagaaaagcttgctttttttggtggcgagtggcgaacgggtgagtaatgtatcggaacgtacccagtagcgggggataactacgcgaaagcgtggctaataccgcatacgccctacgggggaaagggggggatcgaaagacctctcactattggagcggccgatatcggattagctagttggtgaggtaaaggctcaccaaggctgcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaagggcgctggttaatacctggcgttgatgacggtacctgcagaataagcaccggctaactacgtgccagcagccgcggtaatacgtagggtgcaagcgttaatcggaattactgggcgtaaagggtgcgtcggcggtttggcaagaaaggtgtgaaatcccagggcttaaccttggaactgcacttttaactgccaggctagagtacgtcagaggggggtagaattccacgtgtagcagtgaaatgcgtagagatgtggaggaataccgatggcgaaggcagccccctgggatgatactgacgctcaggcacgaaagcgtggggagcaaacaggattagataccctggtagtccacgccctaaacgatgtcaactagctgttggggccgttaggctttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaggccgaagagatttggctgtgctcgcaagagaaccggaacacaggtgctgcatggctgtcgtcagctcgtgtcgtgagatgttgggttaagtcccgcaacgagcgcaacccttgtcattagttgctacgaaagggcactctagtgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggtttcaccagaagtaggtagcctaaccgtaaggggggcgcttaccacggtgggattcatgactggggtgaagtcgtaacaaggtagccgtatcggaaggtgcggctggatcacctccttt

SEQ ID NO: 7444 - DNA, 1545 bp, Pusillimonas sp. L52-1-41
  ref <308>: DATABASE ACCESSION NUMBER: NCBI ACCESSION: NZ_NQYH01000001.1
  ref <309>: DATABASE ENTRY DATE: 2019-04-01
  ref <313>: RELEVANT RESIDUES IN SEQ ID NO: (1)..(1545)
attaaactgaagagtttgatcctggctcagattgaacgctagcgggatgctttacacatgcaagtcgaacggcagcacgagaaaagcttgctttttttggtggcgagtggcgaacgggtgagtaatgtatcggaacgtacccagtagcgggggataactacgcgaaagcgtggctaataccgcatacgccctacgggggaaagggggggattcttttagaacctctcactattggagcggccgatatcggattagctagttggtgaggtaaaggctcaccaaggctgcgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcagggaagaaagggcgctggttaatacctggcgttgatgacggtacctgcagaataagcaccggctaactacgtgccagcagccgcggtaatacgtagggtgcaagcgttaatcggaattactgggcgtaaagggtgcgtcggcggtttggcaagaaaggtgtgaaatcccagggcttaaccttggaactgcacttttaactgccaggctagagtacgtcagaggggggtagaattccacgtgtagcagtgaaatgcgtagagatgtggaggaataccgatggcgaaggcagccccctgggatgatactgacgctcaggcacgaaagcgtggggagcaaacaggattagataccctggtagtccacgccctaaacgatgtcaactagctgttggggccgttaggctttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaggccgaagagatttggctgtgctcgcaagagaaccggaacacaggtgctgcatggctgtcgtcagctcgtgtcgtgagatgttgggttaagtcccgcaacgagcgcaacccttgtcattagttgctacgaaagggcactctagtgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggtttcaccagaagtaggtagcctaaccgtaaggggggcgcttaccacggtgggattcatgactggggtgaagtcgtaacaaggtagccgtatcggaaggtgcggctggatcacctccttt

SEQ ID NO: 7445 - DNA, 1541 bp, Pusillimonas sp. NJUB218
  misc_feature (843)..(843): n is a, c, g, or t
  ref <308>: DATABASE ACCESSION NUMBER: NCBI ACCESSION: NZ_NQMK01000002.1
  ref <309>: DATABASE ENTRY DATE: 2019-04-01
  ref <313>: RELEVANT RESIDUES IN SEQ ID NO: (1)..(1541)
ttaaactgaagagtttgatcctggctcagattgaacgctagcgggatgctttacacatgcaagtcgaacggcagcacgaaaagagcttgctctttttggtggcgagtggcgaacgggtgagtaatgtatcggaacgtacccagtagcgggggataactacgcgaaagcgtggctaataccgcatacgccctacgggggaaagggggggatcgcaagacctctcactattggagcggccgatatcggattagctagttggtggggtaaaggcccaccaaggcaacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcgctgaataatacttggcgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaatggcatttttaactaccgggctagagtatgtcagaggggggtagaattccacgtgtagcagtgaaatgcgtagagatgtggaggaataccgatggcgaaggcagccccctgggataatactgacgctcatgcacgaaagcgtggggagcaaacaggattagataccctggtagtccacgccctaaacgatgtcaactagctgttggggncttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctttagagatagaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggattgcaggctgcaactcgcctgcatgaagtcggaatcgctagtaatcgcggatcagaatgtcgcggtgaatacgttcccgggtcttgtacacaccgcccgtcacaccatgggagtgggtttcaccagaagtaggtagcctaaccgtaaggggggcgcttaccacggtgggattcatgactggggtgaagtcgtaacaaggtagccgtatcggaaggtgcggctggatcacctccttt

SEQ ID NO: 7446 - DNA, 1539 bp, Pusillimonas sp. ye3
  ref <308>: DATABASE ACCESSION NUMBER: NCBI ACCESSION: NZ_CP022987.1
  ref <309>: DATABASE ENTRY DATE: 2019-04-01
  ref <313>: RELEVANT RESIDUES IN SEQ ID NO: (1)..(1539)
agattgaactgaagagtttgatcctggctcagattgaacgctagcgggatgctttacacatgcaagtcgaacggcagcgcgggtcttcggacctggcggcgagtggcgaacgggtgagtaatatatcggaacgtgcccagtagcgggggataactacgcgaaagcgtggctaataccgcatacgccctacgggggaaagggggggatcgcaagacctctcactattggagcggccgatatcggattagctagttggtgaggtaaaggctcaccaaggctgcgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcgccggataatacctggcgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactgccgagctagagtatgtcagaggggggtagaattccacgtgtagcagtgaaatgcgtagagatgtggaggaataccgatggcgaaggcagccccctgggataatactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaagctttaagagattaaagtgtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcaagggggagccaatcccagaaacccgatcgtagtccggattgcaggctgcaactcgcctgcatgaagtcggaatcgctagtaatcgcggatcagaatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctcctttc

SEQ ID NO: 7447 - DNA, 1534 bp, Pygmaiobacter massiliensis
  ref <308>: DATABASE ACCESSION NUMBER: NCBI ACCESSION: NZ_OAML01000003.1
  ref <309>: DATABASE ENTRY DATE: 2019-04-01
  ref <313>: RELEVANT RESIDUES IN SEQ ID NO: (1)..(1534)
ttgattaagagtttgatcctggctcaggacgaacgctggcggcgcgcctaacacatgcaagtcgaacggagcttgcacttctgaagttttcggatggacgaggtacaagcttagtggcgaacgggtgagtaacacgtgaagaacctgcccttcagtgggggacaacagttggaaacgactgctaataccgcataagaccacagtaccgcatggtacagtgatcaaaggatttattcgctgaaggatggcttcgcgtccgattaggtagttggtgaggtaacggcccaccaagcctacgatcggtagccggactgagaggttgatcggccacattgggactgagacacggcccagactcctacgggaggcagcagtggggaatattgcacaatggaggaaactctgatgcagcgacgccgcgtgagggaagaaggtcttcggattgtaaacctctgtcttcagggacgataatgacggtacctgaggaggaagcaccggctaactacgtgccagcagccgcggtaaaacgtagggtgcaagcgttgtccggaattactgggtgtaaagggagcgcaggcgggaagataagttggatgtttaatctacgggctcaacccgtatcagcattcaaaactatttttcttgagtagtgcagaggtaggcggaattcccggtgtagcggtggaatgcgtagatatcgggaggaacaccagtggcgaaggcggcctactgggcactaactgacgctgaggctcgaaagcatgggtagcaaacaggattagataccctggtagtccatgccgtaaacgatgattactaggtgtgggaggattgaccccttccgtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcccgtgcatagtgtagagatacatgaagtccttcgggacacggtgacaggtggtgcatggttgtcgtcagctcgtgtcgtgagatgttgggttaagtcccgcaacgagcgcaacccttattgctagttactacgaaagaggactctagcaagactgccgttgacaaaacggaggaaggtggggatgacgtcaaatcatcatgccctttatgacctgggccacacacgtactacaatggctattaacaaagagatgctaagccgcgaggtggagcgaacctcataaaaatagtctcagttcggattgcaggctgcaactcgcctgcatgaagccggaattgctagtaatcgcggatcagcatgccgcggtgaatacgttcccgggccttgtacacaccgcccgtcacaccatgagagccggggggacccgaagtcagtagtctaaccgcaaggaggacgctgccgaaggtaaaactggtgattggggtgaagtcgtaacaaggtagccgtatcggaaggtgcggctggatcacctcctttctaagga

SEQ ID NO: 7448 - DNA, 1222 bp, Pyramidobacter piscolens
  ref <308>: DATABASE ACCESSION NUMBER: NCBI ACCESSION: NZ_ADFP01000081.1
  ref <309>: DATABASE ENTRY DATE: 2019-04-01
  ref <313>: RELEVANT RESIDUES IN SEQ ID NO: (1)..(1222)
cggagagtttgatcctggctcaggacgaacgctggcggcgtgcttaacacatgcaagttgagcgaggatggttcgagagacttatgttgattggaacattcaagcagcggacgggtgagtaaagcacaaggacttgtccgaaagagagggacacctgcgggaaaccggagctaatacctcataagccggaaggtgaaaagcagagatgcgcttttggagagacttgtgtcctatcaggcagttggtgaggtaacggctcaccaaaccgaagacgggtagccggactgagaggtcgaccggccacattggaactgagagacggtccagactcctacgggaggcagcagtggggaatattgggcaatgggcgcaagcctgacccagcgacgccgcgtgagggaagacagccttcgggttgtaaacctctgttgcaggggaagaaggaagtgacggtaccctgcgaggaagctccggctaactacgtgccagcagccgcggtaatacgtagggagcgagcgttgtccggaattactgggcgtaaagggcgcgtaggcggcgcttcaagtcgtctgtcaaaagccgaggctcaacctcggcgcgcagacgaaactggagagcttgagaagcagagaggcaaacagaattcctggtgtagcggtgaaatgcgtagatatcaggaagaataccagtggcgaaggcggtttgctggctgcatactgacgctgaagcgcgaaagccaggggagcaaacgggattagataccccggtagtcctggcagtaaacgatgtatgctgggtgtgggactagcgatagttccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatccacgcggtagagaagcgaaagcggatcgaccctttcgcaaggaagggaacgtgaacaggtgctgcatggctgtcgtcagctcgtgtcgtgagatgttgggttaagtcccgcaacgagcgcaacccctattgccggttgctaccagtaaaagctgagcactccggcgagactgccatcgacaagatggaggaaggtggggacgacgtcaagtcatcatggcccatatgtccagggcgacacacatgctacaatggatgg

SEQ ID NO: 7449 - DNA, 1451 bp, Pyramidobacter sp. C12-8
  ref <308>: DATABASE ACCESSION NUMBER: NCBI ACCESSION: NZ_MUHX01000063.1
  ref <309>: DATABASE ENTRY DATE: 2019-04-01
  ref <313>: RELEVANT RESIDUES IN SEQ ID NO: (1)..(1451)
gagacatatgttgaattgaatcattcgagcagcggacgggtgagtaaagcacaaggacttgtccgaaagagagggacaccttcgggaaaccggagctaatacctcataagccggaaggtgaaaagcagagatgcgcttttggagagacttgtgtcctatcaggcagttggtgaggtgaaagctcaccaaaccgaagacgggtagccggactgagaggtcgaccggccacattggaactgagagacggtccagactcctacgggaggcagcagtggggaatattgggcaatgggcggaagcctgacccagcgacgccgcgtgagggaagacagccttcgggttgtaaacctctgttgcaggggaagaaggaagtgacggtaccctgcgaggaagctccggctaactacgtgccagcagccgcggtaatacgtagggagcgagcgttgtccggaattactgggcgtaaagggcgcgtaggcggcgcttcaagtcgtctgtcaaatggaagggcttaaccctttttcgcagacgaaactggagagcttgagaagcagagaggcaaacagaattcctggtgtagcggtgaaatgcgtagatatcaggaagaataccagtggcgaaggcggtttgctggctgcatactgacgctgaagcgcgaaagccaggggagcgaacgggattagataccccggtagtcctggcagtaaacgatgtatgctgggtgtgagactagcgatagtttcgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatacacgcggtagagaagcgaaagcggatcgacccctccgcaaggaagggaacgtgaacaggtgctgcatggctgtcgtcagctcgtgtcgtgagatgttgggttaagtcccgcaacgagcgcaacccctattgccagttgctaccaggtaaagctgagcactccggcgagactgccatcgacaagatggaggaaggtggggacgacgtcaagtcatcatggcccatatgtccagggcgacacacatgctacaatggatggtacagagagaagcgagaccggaaggtgaagcagatcccagaaagccatccccagttcggattgcagtctgcaactcgactgcatgaagttggaatcgctagtaatcgcggatcagccaagccgcggtgaatacgttcccgggccttgtacacaccgcccgtcacaccatccgagtcgggtgctctccaagccggaggcctaaccgcaaggaaggatccgcctaaagagtgtccggtgaggagggtgaagtcgtaacaaggtagccgtacgggaacgtgcggctggatcacctcctttctaagga

SEQ ID NO: 7450 - DNA, 1527 bp, Pyramidobacter sp. CG50-2
  ref <308>: DATABASE ACCESSION NUMBER: NCBI ACCESSION: NZ_RAWT01000095.1
  ref <309>: DATABASE ENTRY DATE: 2019-04-01
  ref <313>: RELEVANT RESIDUES IN SEQ ID NO: (1)..(1527)
tcaacggagagtttgatcctggctcaggacgaacgctggcggcgtgcttaacacatgcaagttgagcgaggatgatttgaggagacatatgttgaattgaatcgttcgagcagcggacgggtgagtaaagcacaaggacttgtccgaaagagagggacaccttcgggaaaccggagctaatacctcataagccggaaggtgaaaagcagagatgcgcttttggagagacttgtgtcctatcaggcagttggtgaggtgaaagctcaccaaaccgaagacgggtagccggactgagaggtcgaccggccacattggaactgagagacggtccagactcctacgggaggcagcagtggggaatattgggcaatgggcggaagcctgacccagcgacgccgcgtgagggaagacagccttcgggttgtaaacctctgttgcaggggaagaaggaagtgacggtaccctgcgaggaagctccggctaactacgtgccagcagccgcggtaatacgtagggagcgagcgttgtccggaattactgggcgtaaagggcgcgtaggcggcgcttcaagtcgtctgtcaaatggaagggcttaaccctttttcgcagacgaaactggagagcttgagaagcagagaggcaaacagaattcctggtgtagcggtgaaatgcgtagatatcaggaagaataccagtggcgaaggcggtttgctggctgcatactgacgctgaagcgcgaaagccaggggagcgaacgggattagataccccggtagtcctggcagtaaacgatgtatgctgggtgtgagactagcgatagtttcgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatacacgcggtagagaagcgaaagcggatcgacccctccgcaaggaagggaacgtgaacaggtgctgcatggctgtcgtcagctcgtgtcgtgagatgttgggttaagtcccgcaacgagcgcaacccctattgccagttgctaccaggtaaagctgagcactccggcgagactgccatcgacaagatggaggaaggtggggacgacgtcaagtcatcatggcccatatgtccagggcgacacacatgctacaatggatggtacagagagaagcgagaccggaaggtgaagcagatcccagaaagccatccccagttcggattgcagtctgcaactcgactgcatgaagttggaatcgctagtaatcgcggatcagccaagccgcggtgaatacgttcccgggccttgtacacaccgcccgtcacaccatccgagtcgggtgctctccaagccggaggcctaaccgcaaggaaggatccgcctaaagagtgtccggtgaggagggtgaagtcgtaacaaggtagccgtacgggaacgtgcggctggatcacctcctttct

SEQ ID NO: 7451 - DNA, 1564 bp, Pyrinomonas methylaliphatogenes
  ref <308>: DATABASE ACCESSION NUMBER: NCBI ACCESSION: NZ_CBXV010000008.1
  ref <309>: DATABASE ENTRY DATE: 2019-04-01
  ref <313>: RELEVANT RESIDUES IN SEQ ID NO: (1)..(1564)
gagagtttgatcctggctcagaatcaacgctggcggcgtgcctcagacatgcaagtcgtacgcgaaagagggcttcggccctcgagtagagtggcgtccgggtgagtaacacgtgggtaatctgcctctgggtggggaataacccggggaaacccgggctaataccgcatacagcgacgcagcctgcgggccgcgtcgtgaaagcgggggacctcggcaacgaggcctcgcgcccggagaggagcctgcggcggattagctagttggtgaggtaatggctcaccaaggcgacgatccgtagccggcctgagagggcggtcggccacactggcactgacacacgggccagactcctacgggaggcagcagtcgggaatcttgggcaatgggcgcaagcctgacccagcaacgccgcgtggaggatgaagtccttcgggatgtaaactccgaaagaaggggacgaataagcatgggctaataccccgtgcgatgacggtaccctttgtaagccccggctaactacgtgccagcagccgcggtaatacgtagggggcaagcgttgttcggatttactgggcgtaaagcgcgcgtaggcggcactgcaagtcacttgtgaaatctccgggcttaacccggtaggggccaagtgatactgcagagctagagtgcggaagaggcagctggaattctcggtgtagcggtgaaatgcgtagatatcgagaggaacaccggtggcgaaggcgggctgctgggccgacactgacgctgaggcgcgaaagctaggggagcaaacaggattagataccctggtagtcctagccctaaacgatggatgcttggtgttcggggttctttagtccccgagtgccgcagctaacgcggtaagcatcccgcctggggagtacggtcgcaaggctgaaactcaaaggaattgacggggacccgcacaagcggtggagcatgtggtttaattcgacgcaacgcgaagaaccttacctgggctagaatgcccctgacagccccagagatggggtcttccgggtaacaccggacagggtgcaaggtgctgcatggctgtcgtcagctcgtgtcgtgagatgttgggttaagtcccgcaacgagcgcaacccttgccaacagttgccagcggttcggccgggcactctgttgggactgccgttgataaaacggaggaaggtggggatgacgtcaagtcctcatggcctttatgcccagggctacacacgtgctacaatggccggtacaaagcgctgcgaacccgtgagggggagccaatcgcaaaaagccggtcccagttcggattgcagtctgcaactcgactgcatgaagctggaatcgctagtaatcgcggatcagcatgccgcggtgaatacgttcccgggtcttgtacacaccgcccgtcacatcacgaaagcgggctgtactagaagtggccgcgctaacccgcaagggaggcaggtcacgacggtatggctcgtgattggggtgaagtcgtaacaaggtagccgtaggagaacctgtggctggatcacctcctttctaa

SEQ ID NO: 7452 - DNA, 1522 bp, Quadrisphaera granulorum
  ref <308>: DATABASE ACCESSION NUMBER: NCBI ACCESSION: NZ_UNSG01000057.1
  ref <309>: DATABASE ENTRY DATE: 2019-04-01
  ref <313>: RELEVANT RESIDUES IN SEQ ID NO: (1)..(1522)
ttgatggagagtttgatcctggctcaggacgaacgctggcggcgtgcttaacacatgcaagtcgagcggtgaacccttcggggggatcagcggcgaacgggtgagtaacacgtgagcaacctgcccctgactctgggatagcctcgggaaaccgggattaataccggatatgacattgcctcgcatggggtggtgtggaaagtttttcggttggggatgggctcgcggcctatcagcttgttggtggggtgatggcctaccaaggcgacgacgggtagccggcctgagagggtgaccggccacactgggactgagacacggcccagactcctacgggaggcagcagtggggaatattgcgcaatgggcgaaagcctgacgcagcgacgccgcgtgagggatgaaggccttcgggttgtaaacctctttcagcagggaagaagcgcaagtgacggtacctgcagaagaagcaccggctaactacgtgccagcagccgcggtaatacgtagggtgcaagcgttgtccggaattattgggcgtaaagagctcgtaggcggtttgtcgcgtctgctgtgaaaacgcggggctcaactccgcgcctgcagtgggtacgggcagactagagtgcagtaggggagactggaattcctggtgtagcggtggaatgcgcagatatcaggaggaacaccggtggcgaaggcgggtctctgggctgtaactgacgctgaggagcgaaagcgtgggtagcgaacaggattagataccctggtagtccacgccgtaaacgttgggcgctaggtgtggggctcattccacgagttccgtgccgcagcaaacgcattaagcgccccgcctggggagtacggccgcaaggctaaaactcaaaggaattgacggggccccgcacaagcggcggagcatgcggattaattcgatgcaacgcgaagaaccttaccaaggcttgacatgcagggtaatccggcagagatgtcgggtccgcaagggatcttgcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggatgacgtcaaatcatcatgccccttatgtcttgggcttcacgcatgctacaatggccagtacaaagggctgcgagaccgtgaggtggagcgaatcccaaaaagctggtctcagttcggatcggggtctgcaactcgaccccgtgaagtcggagtcgctagtaatcgcagatcagcaacgctgcggtgaatacgttcccggggcttgtacacaccgcccgtcacgtcacgaaagttggtaacacccgaagccggtggcctaacccttgtggggggagccgtcgaaggtgggactggcgattgggacgaagtcgtaacaaggtagccgtaccggaaggtgcggctggatcacctcctttctaaggag

SEQ ID NO: 7453 - DNA, 1556 bp, Quasibacillus thermotolerans
  ref <308>: DATABASE ACCESSION NUMBER: NCBI ACCESSION: NZ_JWIR02000016.1
  ref <309>: DATABASE ENTRY DATE: 2019-04-01
  ref <313>: RELEVANT RESIDUES IN SEQ ID NO: (1)..(1556)
tttttggagagtttgatcctggctcaggacgaacgctggcggcgtgcctaatacatgcaagtcgagcggacggaagggagcttgctcccggaagtcagcggcggacgggtgagtaacacgtgggtaacctgcctgtaagactgggataactccgggaaaccggggctaataccggatagcttcttcctccgcatggaggaagaatgaaaggcggcctttggctgtcacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccggagtcactgccggtaccttgacggtacctgaccagaaagccacggctaactacgtgccagcagccgcggtaatacgtaggtggcaagcgttgtccggaattattgggcgtaaagcgcgcgcaggcggccttttaagtctgatgtgaaagcccacggctcaaccgtggagggtcattggaaactggaaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacacctctggagacagagcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttcta

SEQ ID NO: 7454 - DNA, 1550 bp, Rahnella aquatilis
ttaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7455 - DNA, 1550 bp, Rahnella aquatilis; identical to SEQ ID NO: 7454

SEQ ID NO: 7456 - DNA, 1550 bp, Rahnella aquatilis; identical to SEQ ID NO: 7454

SEQ ID NO: 7457 - DNA, 1550 bp, Rahnella aquatilis
  ref <308>: DATABASE ACCESSION NUMBER: NCBI ACCESSION: NZ_CP034483.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7458 - DNA, 1552 bp, Rahnella bruchi
  ref <308>: DATABASE ACCESSION NUMBER: NCBI ACCESSION: NZ_QZWI01000037.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgacaaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 7459 - DNA, 1552 bp, Rahnella inusitata
  ref <308>: DATABASE ACCESSION NUMBER: NCBI ACCESSION: NZ_RAHG01000022.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcgctgtagttaatagctgcaacgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgctagagatagcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 7460 - DNA, 656 bp, Rahnella sp. AA
  ref <308>: DATABASE ACCESSION NUMBER: NCBI ACCESSION: NZ_PITQ01000034.1
  ref <309>: DATABASE ENTRY DATE: 2019-04-01
  ref <313>: RELEVANT RESIDUES IN SEQ ID NO: (1)..(656)
ggccgcaaggttaaaactcaaatgaattgacgggggcccgcacaagcggtggagcatgtggtttaattcgatgcaacgcgaagaaccttacctactcttgacatccagagaattcgctagagatagcgtagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7461 - DNA, 1550 bp, Rahnella sp. AN3-3W3
  ref <308>: DATABASE ACCESSION NUMBER: NCBI ACCESSION: NZ_JYDG01000113.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7462 - DNA, 1477 bp, Rahnella sp. CFA14 1 10
  ref <308>: DATABASE ACCESSION NUMBER: NCBI ACCESSION: NZ_SEWS01000024.1
  ref <309>: DATABASE ENTRY DATE: 2019-04-01
  ref <313>: RELEVANT RESIDUES IN SEQ ID NO: (1)..(1477)
cgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7463 - DNA, 1552 bp, Rahnella sp. DSM 30078
  ref <308>: DATABASE ACCESSION NUMBER: NCBI ACCESSION: NZ_JYDE01000035.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcgttgtagttaatagctgcagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgctagagatagcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 7464 - DNA, 1550 bp, Rahnella sp. ERMR1 05
  ref <308>: DATABASE ACCESSION NUMBER: NCBI ACCESSION: NZ_CP019062.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcatgatgtcgcaagaccaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggcagtgtgttaatagcacgctgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaaatcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7465 - DNA, 1552 bp, Rahnella sp. Larv3 ips
  ref <308>: DATABASE ACCESSION NUMBER: NCBI ACCESSION: NZ_MJIB01000021.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgagcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 7466 - DNA, 1550 bp, Rahnella sp. NFIX50; identical to SEQ ID NO: 7457
  ref <308>: DATABASE ACCESSION NUMBER: NCBI ACCESSION: NZ_QLTF01000029.1
  ref <309>: DATABASE ENTRY DATE: 2019-04-01
  ref <313>: RELEVANT RESIDUES IN SEQ ID NO: (1)..(1550)

SEQ ID NO: 7467 - DNA, 1550 bp, Rahnella sp. NRRL B-41462; identical to SEQ ID NO: 7454
  ref <308>: DATABASE ACCESSION NUMBER: NCBI ACCESSION: NZ_JYDF01000105.1
  ref <309>: DATABASE ENTRY DATE: 2019-04-01
  ref <313>: RELEVANT RESIDUES IN SEQ ID NO: (1)..(1550)

SEQ ID NO: 7468 - DNA, 1477 bp, Rahnella sp. RFA10 1 100
  ref <308>: DATABASE ACCESSION NUMBER: NCBI ACCESSION: NZ_SEWR01000020.1
  ref <309>: DATABASE ENTRY DATE: 2019-04-01
  ref <313>: RELEVANT RESIDUES IN SEQ ID NO: (1)..(1477)
cgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7469 - DNA, 1550 bp, Rahnella variigena
  ref <308>: DATABASE ACCESSION NUMBER: NCBI ACCESSION: NZ_QKVV01000001.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgwgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggrgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 7470 - DNA, 1552 bp, Rahnella victoriana
  ref <308>: DATABASE ACCESSION NUMBER: NCBI ACCESSION: NZ_MAEN01000001.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgaacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttagggagggcgcttaccactttgtgattcatgactggggtgaagtcgtaacaaggtaaccgtaggggaacctgcggttggatcacctccttacctaaaga

SEQ ID NO: 7471 - DNA, 1552 bp, Rahnella woolbedingensis
  ref <308>: DATABASE ACCESSION NUMBER: NCBI ACCESSION: NZ_RAHH01000065.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgacaaaccggaggaaggtggggatgacgtcaagtcatcatggcccttacgagtagggctacacacgtgctacaatggcatatacaaagagaagcaaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 7472 - DNA, 1519 bp, Raineya orbicola
  ref <308>: DATABASE ACCESSION NUMBER: NCBI ACCESSION: NZ_NKXO01000050.1
  ref <309>: DATABASE ENTRY DATE: 2019-04-01
  ref <313>: RELEVANT RESIDUES IN SEQ ID NO: (1)..(1519)
tttacaatgaagagtttgatcctggctcaggatgaacgctagcggcgggcctaatacatgcaagtcgaacgggataggtggcgacaccttgagagtggcgtacgggtgcgtaacgcgtatacaacctgcctgttacacggggatagccttgcgaaagcgagattaatacccgatagtactatcaggtggcatcactttgtagttaaagctgaggcggtaacagaggggtatgcgtcccattagctagttggtaaggtaacggcttaccaaggctacgatgggtaggggttctgagaggatgatcccccacactggtactgagatacggaccagactcctacgggaggcagcagtagggaatattgggcaatggacggaagtctgacccagccacgccgcgtgcaggaagaaggtcctctggattgtaaactgcttttcttggggaagaaaaagcttctgcggaagttattgacggtactcaaggaataagcatcggctaactccgtgccagcagccgcggtaatacggaggatgcgagcgttgtccggatttactgggtttaaagggtgcgtaggcgggcgattaagtgagaattgaaaggcagtcgctcaacgattgtaaggttctcatactggttgtcttgagagtagtggaggcagatggaatgagtggagtagcggtgaaatgcatagataccacttggaacaccgattgcgaaggcattctgctacgctatatctgacgctgaggcacgaaagcgtggggagcaaacaggattagataccctggtagtccacgccctaaacgatggttactcggtgttcgcctgtataggtgagtgcctaagcgaaagcgataagtaacccacctggggagtacgaccgcaaggttgaaactcaaaggaattgacgggggtccgcacaagcggtggagcatgtggtttaattcgacgatacgcgaggaaccttacctggtctagaatgtgagggaatggcgcagagatgtgtcagtccgcaaggacccgaaacaaggtgctgcatggctgtcgtcagttcgtgccgtgaggtgttgggttaagtcccgcaacgaacgcaacccctatcggtagttgccagcgagtaaagtcggggactctaccgaaactgcctacgcaagtagagaggaaggtggggacgacgtcaagtcatcacggcccttacgaccagggcgacacacgtgctacaatgggcggtacagagggtagcgaggtggtgacactgagccaatcttgaaagccgctctcagttcggattgcaggctgcaactcgcctgtatgaagctggaatcgctagtaatcgcagatcagccatgctgcggtgaatacgttcccggaccttgtacacaccgcccgtcaagccatgggagtcgggtggacttgaagctggcaggttcagtgccagttagagttaaaccgatgactggggctaagtcgtaacaaggtagccgtaccggaaggtgtggctggaacacctcctttatg

SEQ ID NO: 7473 - DNA, 1541 bp, Ralstonia pseudosolanacearum
  ref <308>: DATABASE ACCESSION NUMBER: NCBI ACCESSION: NZ_RJTL01000119.1
  ref <309>: DATABASE ENTRY DATE: 2019-04-01
  ref <313>: RELEVANT RESIDUES IN SEQ ID NO: (1)..(1541)
agattgaactgaagagtttgatcctggctcagattgaacgctggcggcatgccttacacatgcaagtcgaacggcagcgggggtagcttgctacctgccggcgagtggcgaacgggtgagtaatacatcggaacgtgccctgtagtgggggataactagtcgaaagactagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcgcactggttaatacctggtgtggatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgggcttaacctgggaattgcattggtgactgcacggctagagtgtgtcagagggaggtagaattccacgtgtagcagtgaaatgcgtagagatgtggaggaataccgatggcgaaggcagcctcctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 7474 - DNA, 1541 bp, Ralstonia solanacearum; identical to SEQ ID NO: 7473
  ref <308>: DATABASE ACCESSION NUMBER: NCBI ACCESSION: NZ_CP022481.1
  ref <309>: DATABASE ENTRY DATE: 2019-04-01
  ref <313>: RELEVANT RESIDUES IN SEQ ID NO: (1)..(1541)

SEQ ID NO: 7475 - DNA, 1543 bp, Ralstonia sp. GV074
  ref <308>: DATABASE ACCESSION NUMBER: NCBI ACCESSION: NZ_QEOI01000032.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcgaggagggcgattaccacggtagggttcatgactggggtgaagtcgtaacaaggtagccgtatcggaaggtgcggctggatcacctccttt

SEQ ID NO: 7476 - DNA, 1543 bp, Ralstonia sp. SET104
  ref <308>: DATABASE ACCESSION NUMBER: NCBI ACCESSION: NZ_BHVX01000036.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgccttacacatgcaagtcgaacggcagcgggggaaagcttgctttcctgccggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 7477 - DNA, 1550 bp, Raoultella planticola
  ref <308>: DATABASE ACCESSION NUMBER: NCBI ACCESSION: NZ_LR134195.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 7478 - DNA, 1461 bp, Raoultella sp. BIGb0399
  ref <308>: DATABASE ACCESSION NUMBER: NCBI ACCESSION: NZ_RKHT01000004.1
  ref <309>: DATABASE ENTRY DATE: 2019-04-01
  ref <313>: RELEVANT RESIDUES IN SEQ ID NO: (1)..(1461)
cgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 7479 - DNA, 1546 bp, Raoultella sp. T31
  ref <308>: DATABASE ACCESSION NUMBER: NCBI ACCESSION: NZ_PIBO01000080.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcaccaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 7480 - DNA, 1550 bp, Raoultella sp. X13
  ref <308>: DATABASE ACCESSION NUMBER: NCBI ACCESSION: NZ_CP030874.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 7481 - DNA, 1489 bp, Raphidiopsis brookii
  ref <308>: DATABASE ACCESSION NUMBER: NCBI ACCESSION: NZ_ACYB01000037.1
  ref <309>: DATABASE ENTRY DATE: 2019-04-01
  ref <313>: RELEVANT RESIDUES IN SEQ ID NO: (1)..(1489)
aaaacggagagtttgatcctggctcaggatgaacgctggcggtatgcttaacacatgcaagtcgaacgagatgcttaggcatctagtggcggacgggtgagtaacgcgtgagaatctggctccaggtcggggacaacagttggaaacgactgctaataccggatgtgccgagaggtgaaagatttatcgcctggagatgagctcgcgtctgattagctagttggtggtgtaagggactaccaaggcatcgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggtcgtaaacctcttttctcaaggaagaagaaagtgacggtacttgaggaataagcatcggctaactccgtgccagcagccgcggtaatacggaggatgcaagcgttatccggaatgattgggcgtaaagggtctgcaggtggaactgaaagtctgctgttaaagagtttggcttaaccaaataaaagcggtggaaactacagaactagagtgcggtaggggcaaaaggaattcctggtgtagcggtgaaatgcgtagatatcaggaagaacaccggtggcgaaagcgttttgctagaccgtaactgacactgagggacgaaagctaggggagcgaatgggattagataccccagtagtcctagccgtaaacgatggatactaggcgtggcttgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatcctgcgaatcccagtgaaagctgggagtgccttagggagcgcagagacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtgaggatgacgtcaagtcagcatgccccttacgtcttgggctacacacgtactacaatgctacggacagagggcagcgagccagggatggcaagcgaatccagaaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagttggtcacgcccgaagtcattaccccaaccgaaaggagggggatgcctaaggtaggactggtgactggggtgaagtcgtaacaaggtagccgtaccggaaggtgtggctggatcacctcctttt

SEQ ID NO: 7482 - DNA, 1530 bp, Rathayibacter festucae
  ref <308>: DATABASE ACCESSION NUMBER: NCBI ACCESSION: NZ_CP028137.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcaggtagttggtgaggtaatggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7483 - DNA, 1530 bp, Rathayibacter iranicus
  ref <308>: DATABASE ACCESSION NUMBER: NCBI ACCESSION: NZ_CP028130.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcctggcttgctgggtggattagtggcgaacgggtgagtaacacgtgagtaacctgcccttgactctgggataagcgctggaaacggcgtctaataccggatacgacctgccccggcatcgggtgtgggtggaaagtttttcggtcaaggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtgggggcctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagagatggttgccccgcaaggtcggtatacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgtaaggagggagctgtcgaaggtgggatcggtgattaggactaagtcgtaacaaggtagccgtaccggaaggtgcggctggatcacctcctttctaagga

SEQ ID NO: 7484 - DNA, 1530 bp, Rathayibacter rathayi
  ref <308>: DATABASE ACCESSION NUMBER: NCBI ACCESSION: NZ_OCNL01000027.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcctagcttgctgggtggattagtggcgaacgggtgagtaacacgtgagtaacctgcccttgactctgggataagcgctggaaacggcgtctaataccggatatgacctgccccggcatcgggtgtgggtggaaagtttttcggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgtaaggagggagctgtcgaaggtgggatcggtgattaggactaagtcgtaacaaggtagccgtaccggaaggtgcggctggatcacctcctttctaagga

SEQ ID NO: 7485 - DNA, 1530 bp, Rathayibacter sp. AY1A1
  ref <308>: DATABASE ACCESSION NUMBER: NCBI ACCESSION: NZ_PSXV01000065.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgatactgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7486 - DNA, 1530 bp, Rathayibacter sp. AY1A2
  ref <308>: DATABASE ACCESSION NUMBER: NCBI ACCESSION: NZ_PSTP01000042.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7487 - DNA, 1530 bp, Rathayibacter sp. AY1A3; identical to SEQ ID NO: 7486
  ref <308>: DATABASE ACCESSION NUMBER: NCBI ACCESSION: NZ_PSTO01000066.1
  ref <309>: DATABASE ENTRY DATE: 2019-04-01
  ref <313>: RELEVANT RESIDUES IN SEQ ID NO: (1)..(1530)

SEQ ID NO: 7488 - DNA, 1530 bp, Rathayibacter sp. AY1A4; identical to SEQ ID NO: 7486
  ref <308>: DATABASE ACCESSION NUMBER: NCBI ACCESSION: NZ_PSTN01000051.1
  ref <309>: DATABASE ENTRY DATE: 2019-04-01
  ref <313>: RELEVANT RESIDUES IN SEQ ID NO: (1)..(1530)

SEQ ID NO: 7489 - DNA, 1530 bp, Rathayibacter sp. AY1A5; identical to SEQ ID NO: 7486
  ref <308>: DATABASE ACCESSION NUMBER: NCBI ACCESSION: NZ_PSTM01000043.1
  ref <309>: DATABASE ENTRY DATE: 2019-04-01
  ref <313>: RELEVANT RESIDUES IN SEQ ID NO: (1)..(1530)

SEQ ID NO: 7490 - DNA, 1530 bp, Rathayibacter sp. AY1A7; identical to SEQ ID NO: 7486
  ref <308>: DATABASE ACCESSION NUMBER: NCBI ACCESSION: NZ_PSTL01000045.1
  ref <309>: DATABASE ENTRY DATE: 2019-04-01
  ref <313>: RELEVANT RESIDUES IN SEQ ID NO: (1)..(1530)

SEQ ID NO: 7491 - DNA, 944 bp, Rathayibacter sp. AY1B1
  ref <308>: DATABASE ACCESSION NUMBER: NCBI ACCESSION: NZ_PSWO01000069.1
  ref <309>: DATABASE ENTRY DATE: 2019-04-01
  ref <313>: RELEVANT RESIDUES IN SEQ ID NO: (1)..(944)
aaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7492 - DNA, 897 bp, Rathayibacter sp. AY1B4
  ref <308>: DATABASE ACCESSION NUMBER: NCBI ACCESSION: NZ_PSWN01000047.1
  ref <309>: DATABASE ENTRY DATE: 2019-04-01
  ref <313>: RELEVANT RESIDUES IN SEQ ID NO: (1)..(897)
gagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7493 - DNA, 1530 bp, Rathayibacter sp. AY1B5; identical to SEQ ID NO: 7486
  ref <308>: DATABASE ACCESSION NUMBER: NCBI ACCESSION: NZ_PSWM01000046.1
  ref <309>: DATABASE ENTRY DATE: 2019-04-01
  ref <313>: RELEVANT RESIDUES IN SEQ ID NO: (1)..(1530)

SEQ ID NO: 7494 - DNA, 944 bp, Rathayibacter sp. AY1B6; identical to SEQ ID NO: 7491
  ref <308>: DATABASE ACCESSION NUMBER: NCBI ACCESSION: NZ_PSWL01000046.1
  ref <309>: DATABASE ENTRY DATE: 2019-04-01
  ref <313>: RELEVANT RESIDUES IN SEQ ID NO: (1)..(944)

SEQ ID NO: 7495 - DNA, 1530 bp, Rathayibacter sp. AY1B7; identical to SEQ ID NO: 7486
  ref <308>: DATABASE ACCESSION NUMBER: NCBI ACCESSION: NZ_PSWK01000060.1
  ref <309>: DATABASE ENTRY DATE: 2019-04-01
  ref <313>: RELEVANT RESIDUES IN SEQ ID NO: (1)..(1530)

SEQ ID NO: 7496 - DNA, 1530 bp, Rathayibacter sp. AY1B8; identical to SEQ ID NO: 7486
  ref <308>: DATABASE ACCESSION NUMBER: NCBI ACCESSION: NZ_PSWJ01000048.1
  ref <309>: DATABASE ENTRY DATE: 2019-04-01
  ref <313>: RELEVANT RESIDUES IN SEQ ID NO: (1)..(1530)

SEQ ID NO: 7497 - DNA, 1530 bp, Rathayibacter sp. AY1C1; identical to SEQ ID NO: 7486
  ref <308>: DATABASE ACCESSION NUMBER: NCBI ACCESSION: NZ_PSWH01000065.1
  ref <309>: DATABASE ENTRY DATE: 2019-04-01
  ref <313>: RELEVANT RESIDUES IN SEQ ID NO: (1)..(1530)

SEQ ID NO: 7498 - DNA, 1530 bp, Rathayibacter sp. AY1C2; identical to SEQ ID NO: 7486
  ref <308>: DATABASE ACCESSION NUMBER: NCBI ACCESSION: NZ_PSWG01000040.1
  ref <309>: DATABASE ENTRY DATE: 2019-04-01
  ref <313>: RELEVANT RESIDUES IN SEQ ID NO: (1)..(1530)

SEQ ID NO: 7499 - DNA, 1530 bp, Rathayibacter sp. AY1C3; identical to SEQ ID NO: 7486
  ref <308>: DATABASE ACCESSION NUMBER: NCBI ACCESSION: NZ_PSWF01000063.1
  ref <309>: DATABASE ENTRY DATE: 2019-04-01
  ref <313>: RELEVANT RESIDUES IN SEQ ID NO: (1)..(1530)

SEQ ID NO: 7500 - DNA, 986 bp, Rathayibacter sp. AY1C4
  ref <308>: DATABASE ACCESSION NUMBER: NCBI ACCESSION: NZ_PSWE01000069.1
  ref <309>: DATABASE ENTRY DATE: 2019-04-01
  ref <313>: RELEVANT RESIDUES IN SEQ ID NO: (1)..(986)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccgg

SEQ ID NO: 7501 - DNA, 1530 bp, Rathayibacter sp. AY1C5; identical to SEQ ID NO: 7486
  ref <308>: DATABASE ACCESSION NUMBER: NCBI ACCESSION: NZ_PSWD01000052.1
  ref <309>: DATABASE ENTRY DATE: 2019-04-01
  ref <313>: RELEVANT RESIDUES IN SEQ ID NO: (1)..(1530)

SEQ ID NO: 7502 - DNA, 1530 bp, Rathayibacter sp. AY1C6; identical to SEQ ID NO: 7486
  ref <308>: DATABASE ACCESSION NUMBER: NCBI ACCESSION: NZ_PSWC01000045.1
  ref <309>: DATABASE ENTRY DATE: 2019-04-01
  ref <313>: RELEVANT RESIDUES IN SEQ ID NO: (1)..(1530)

SEQ ID NO: 7503 - DNA, 1530 bp, Rathayibacter sp. AY1C7; identical to SEQ ID NO: 7486
  ref <308>: DATABASE ACCESSION NUMBER: NCBI ACCESSION: NZ_PSWB01000055.1
  ref <309>: DATABASE ENTRY DATE: 2019-04-01
  ref <313>: RELEVANT RESIDUES IN SEQ ID NO: (1)..(1530)

SEQ ID NO: 7504 - DNA, 1530 bp, Rathayibacter sp. AY1C9; identical to SEQ ID NO: 7486
  ref <308>: DATABASE ACCESSION NUMBER: NCBI ACCESSION: NZ_PSVZ01000050.1
  ref <309>: DATABASE ENTRY DATE: 2019-04-01
  ref <313>: RELEVANT RESIDUES IN SEQ ID NO: (1)..(1530)

SEQ ID NO: 7505 - DNA, 997 bp, Rathayibacter sp. AY1D2
  ref <308>: DATABASE ACCESSION NUMBER: NCBI ACCESSION: NZ_PSVX01000129.1
  ref <309>: DATABASE ENTRY DATE: 2019-04-01
  ref <313>: RELEVANT RESIDUES IN SEQ ID NO: (1)..(997)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccaga

SEQ ID NO: 7506 - DNA, 1530 bp, Rathayibacter sp. AY1D3; identical to SEQ ID NO: 7486
  ref <308>: DATABASE ACCESSION NUMBER: NCBI ACCESSION: NZ_PSVW01000046.1
  ref <309>: DATABASE ENTRY DATE: 2019-04-01
  ref <313>: RELEVANT RESIDUES IN SEQ ID NO: (1)..(1530)

SEQ ID NO: 7507 - DNA, 1370 bp, Rathayibacter sp. AY1D4
  ref <308>: DATABASE ACCESSION NUMBER: NCBI ACCESSION: NZ_PSVV01000067.1
  ref <309>: DATABASE ENTRY DATE: 2019-04-01
  ref <313>: RELEVANT RESIDUES IN SEQ ID NO: (1)..(1370)
cgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7508 - DNA, 1530 bp, Rathayibacter sp. AY1D5; identical to SEQ ID NO: 7486
  ref <308>: DATABASE ACCESSION NUMBER: NCBI ACCESSION: NZ_PSVU01000097.1
  ref <309>: DATABASE ENTRY DATE: 2019-04-01
  ref <313>: RELEVANT RESIDUES IN SEQ ID NO: (1)..(1530)

SEQ ID NO: 7509 - DNA, 1000 bp, Rathayibacter sp. AY1D7
  ref <308>: DATABASE ACCESSION NUMBER: NCBI ACCESSION: NZ_PSVS01000003.1
  ref <309>: DATABASE ENTRY DATE: 2019-04-01
  ref <313>: RELEVANT RESIDUES IN SEQ ID NO: (1)..(1000)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaat

SEQ ID NO: 7510 - DNA, 1290 bp, Rathayibacter sp. AY1D9
  ref <308>: DATABASE ACCESSION NUMBER: NCBI ACCESSION: NZ_PSVQ01000069.1
  ref <309>: DATABASE ENTRY DATE: 2019-04-01
  ref <313>: RELEVANT RESIDUES IN SEQ ID NO: (1)..(1290)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattga

SEQ ID NO: 7511 - DNA, 1530 bp, Rathayibacter sp. AY1E1; identical to SEQ ID NO: 7486
  ref <308>: DATABASE ACCESSION NUMBER: NCBI ACCESSION: NZ_PSVP01000091.1
  ref <309>: DATABASE ENTRY DATE: 2019-04-01
  ref <313>: RELEVANT RESIDUES IN SEQ ID NO: (1)..(1530)

SEQ ID NO: 7512 - DNA, 1530 bp, Rathayibacter sp. AY1E2; identical to SEQ ID NO: 7486
  ref <308>: DATABASE ACCESSION NUMBER: NCBI ACCESSION: NZ_PSVO01000046.1
  ref <309>: DATABASE ENTRY DATE: 2019-04-01
  ref <313>: RELEVANT RESIDUES IN SEQ ID NO: (1)..(1530)

SEQ ID NO: 7513 - DNA, 1530 bp, Rathayibacter sp. AY1E3; identical to SEQ ID NO: 7486
  ref <308>: DATABASE ACCESSION NUMBER: NCBI ACCESSION: NZ_PSVN01000041.1
  ref <309>: DATABASE ENTRY DATE: 2019-04-01
  ref <313>: RELEVANT RESIDUES IN SEQ ID NO: (1)..(1530)

SEQ ID NO: 7514 - DNA, 991 bp, Rathayibacter sp. AY1E4
  ref <308>: DATABASE ACCESSION NUMBER: NCBI ACCESSION: NZ_PSVM01000070.1
  ref <309>: DATABASE ENTRY DATE: 2019-04-01
  ref <313>: RELEVANT RESIDUES IN SEQ ID NO: (1)..(991)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaact

SEQ ID NO: 7515 - DNA, 1530 bp, Rathayibacter sp. AY1E5; identical to SEQ ID NO: 7486
  ref <308>: DATABASE ACCESSION NUMBER: NCBI ACCESSION: NZ_PSVL01000068.1
  ref <309>: DATABASE ENTRY DATE: 2019-04-01
  ref <313>: RELEVANT RESIDUES IN SEQ ID NO: (1)..(1530)

SEQ ID NO: 7516 - DNA, 1530 bp, Rathayibacter sp. AY1E6; identical to SEQ ID NO: 7486
  ref <308>: DATABASE ACCESSION NUMBER: NCBI ACCESSION: NZ_PSVK01000041.1
  ref <309>: DATABASE ENTRY DATE: 2019-04-01
  ref <313>: RELEVANT RESIDUES IN SEQ ID NO: (1)..(1530)

SEQ ID NO: 7517 - DNA, 1331 bp, Rathayibacter sp. AY1E8
  ref <308>: DATABASE ACCESSION NUMBER: NCBI ACCESSION: NZ_PSVI01000103.1
  ref <309>: DATABASE ENTRY DATE: 2019-04-01
  ref <313>: RELEVANT RESIDUES IN SEQ ID NO: (1)..(1331)
gggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7518 - DNA, 1530 bp, Rathayibacter sp. AY1E9; identical to SEQ ID NO: 7486
  ref <308>: DATABASE ACCESSION NUMBER: NCBI ACCESSION: NZ_PSVH01000068.1
  ref <309>: DATABASE ENTRY DATE: 2019-04-01
  ref <313>: RELEVANT RESIDUES IN SEQ ID NO: (1)..(1530)

SEQ ID NO: 7519 - DNA, 1530 bp, Rathayibacter sp. AY1F2; identical to SEQ ID NO: 7486
  ref <308>: DATABASE ACCESSION NUMBER: NCBI ACCESSION: NZ_PSVG01000041.1
  ref <309>: DATABASE ENTRY DATE: 2019-04-01
  ref <313>: RELEVANT RESIDUES IN SEQ ID NO: (1)..(1530)

SEQ ID NO: 7520 - DNA, 1530 bp, Rathayibacter sp. AY1F3; identical to SEQ ID NO: 7486
  ref <308>: DATABASE ACCESSION NUMBER: NCBI ACCESSION: NZ_PSVF01000058.1
  ref <309>: DATABASE ENTRY DATE: 2019-04-01
  ref <313>: RELEVANT RESIDUES IN SEQ ID NO: (1)..(1530)

SEQ ID NO: 7521 - DNA, 1530 bp, Rathayibacter sp. AY1F6; identical to SEQ ID NO: 7486
  ref <308>: DATABASE ACCESSION NUMBER: NCBI ACCESSION: NZ_PSVD01000041.1
  ref <309>: DATABASE ENTRY DATE: 2019-04-01
  ref <313>: RELEVANT RESIDUES IN SEQ ID NO: (1)..(1530)

SEQ ID NO: 7522 - DNA, 1530 bp, Rathayibacter sp. AY1F7; identical to SEQ ID NO: 7486
  ref <308>: DATABASE ACCESSION NUMBER: NCBI ACCESSION: NZ_PSVC01000058.1
  ref <309>: DATABASE ENTRY DATE: 2019-04-01
  ref <313>: RELEVANT RESIDUES IN SEQ ID NO: (1)..(1530)

SEQ ID NO: 7523 - DNA, 1530 bp, Rathayibacter sp. AY1F8; identical to SEQ ID NO: 7486
  ref <308>: DATABASE ACCESSION NUMBER: NCBI ACCESSION: NZ_PSVB01000043.1
  ref <309>: DATABASE ENTRY DATE: 2019-04-01
  ref <313>: RELEVANT RESIDUES IN SEQ ID NO: (1)..(1530)

SEQ ID NO: 7524 - DNA, 1530 bp, Rathayibacter sp. AY1F9; identical to SEQ ID NO: 7486
  ref <308>: DATABASE ACCESSION NUMBER: NCBI ACCESSION: NZ_PSVA01000047.1
  ref <309>: DATABASE ENTRY DATE: 2019-04-01
  ref <313>: RELEVANT RESIDUES IN SEQ ID NO: (1)..(1530)

SEQ ID NO: 7525 - DNA, 1530 bp, Rathayibacter sp. AY1G1
  ref <308>: DATABASE ACCESSION NUMBER: NCBI ACCESSION: NZ_PSUZ01000052.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggattagtggcgaacgggtgagtaacacgtgagtaacctgcccttgactctgggataagcgctggaaacggcgtctaataccggatacgacctgccccggcatcgggtgtgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7526 - DNA, 1530 bp, Rathayibacter sp. AY1G9; identical to SEQ ID NO: 7485
  ref <308>: DATABASE ACCESSION NUMBER: NCBI ACCESSION: NZ_PSUW01000064.1
  ref <309>: DATABASE ENTRY DATE: 2019-04-01
  ref <313>: RELEVANT RESIDUES IN SEQ ID NO: (1)..(1530)

SEQ ID NO: 7527 - DNA, 1530 bp, Rathayibacter sp. AY1H3; identical to SEQ ID NO: 7486
  ref <308>: DATABASE ACCESSION NUMBER: NCBI ACCESSION: NZ_PSUU01000080.1
  ref <309>: DATABASE ENTRY DATE: 2019-04-01
  ref <313>: RELEVANT RESIDUES IN SEQ ID NO: (1)..(1530)

SEQ ID NO: 7528 - DNA, 1530 bp, Rathayibacter sp. AY2B3; identical to SEQ ID NO: 7486
  ref <308>: DATABASE ACCESSION NUMBER: NCBI ACCESSION: NZ_PSUG01000082.1
  ref <309>: DATABASE ENTRY DATE: 2019-04-01
  ref <313>: RELEVANT RESIDUES IN SEQ ID NO: (1)..(1530)

SEQ ID NO: 7529 - DNA, 1241 bp, Rathayibacter sp. AY2B5
  ref <308>: DATABASE ACCESSION NUMBER: NCBI ACCESSION: NZ_PSUE01000055.1
  ref <309>: DATABASE ENTRY DATE: 2019-04-01
  ref <313>: RELEVANT RESIDUES IN SEQ ID NO: (1)..(1241)
cctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7530 - DNA, 1530 bp, Rathayibacter sp. AY2B9; identical to SEQ ID NO: 7486
  ref <308>: DATABASE ACCESSION NUMBER: NCBI ACCESSION: NZ_PSUB01000033.1
  ref <309>: DATABASE ENTRY DATE: 2019-04-01
  ref <313>: RELEVANT RESIDUES IN SEQ ID NO: (1)..(1530)

SEQ ID NO: 7531 - DNA, 1530 bp, Rathayibacter sp. PhB127; identical to SEQ ID NO: 7482
  ref <308>: DATABASE ACCESSION NUMBER: NCBI ACCESSION: NZ_RKHW01000009.1
  ref <309>: DATABASE ENTRY DATE: 2019-04-01
  ref <313>: RELEVANT RESIDUES IN SEQ ID NO: (1)..(1530)

SEQ ID NO: 7532 - DNA, 1530 bp, Rathayibacter sp. PhB152; identical to SEQ ID NO: 7482
  ref <308>: DATABASE ACCESSION NUMBER: NCBI ACCESSION: NZ_RJUT01000016.1
  ref <309>: DATABASE ENTRY DATE: 2019-04-01
  ref <313>: RELEVANT RESIDUES IN SEQ ID NO: (1)..(1530)

SEQ ID NO: 7533 - DNA, 1530 bp, Rathayibacter sp. PhB185; identical to SEQ ID NO: 7482
  ref <308>: DATABASE ACCESSION NUMBER: NCBI ACCESSION: NZ_RKIB01000016.1
  ref <309>: DATABASE ENTRY DATE: 2019-04-01
  ref <313>: RELEVANT RESIDUES IN SEQ ID NO: (1)..(1530)

SEQ ID NO: 7534 - DNA, 1530 bp, Rathayibacter sp. PhB186; identical to SEQ ID NO: 7482
  ref <308>: DATABASE ACCESSION NUMBER: NCBI ACCESSION: NZ_RJKO01000016.1
  ref <309>: DATABASE ENTRY DATE: 2019-04-01
  ref <313>: RELEVANT RESIDUES IN SEQ ID NO: (1)..(1530)

SEQ ID NO: 7535 - DNA, 1530 bp, Rathayibacter sp. PhB93; identical to SEQ ID NO: 7482
  ref <308>: DATABASE ACCESSION NUMBER: NCBI ACCESSION: NZ_RJLA01000007.1
  ref <309>: DATABASE ENTRY DATE: 2019-04-01
  ref <313>: RELEVANT RESIDUES IN SEQ ID NO: (1)..(1530)

SEQ ID NO: 7536 - DNA, 1553 bp, Rathayibacter sp. RFBD1
  ref <308>: DATABASE ACCESSION NUMBER: NCBI ACCESSION: NZ_PSWQ01000030.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctttgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 7537 - DNA, 1530 bp, Rathayibacter sp. TRS19
  ref <308>: DATABASE ACCESSION NUMBER: NCBI ACCESSION: NZ_PSWR01000146.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggcggattagtggcgaacgggtgagtaacacgtgagtaacctgcccttgactctgggataagcgctggaaacggcgtctaataccggatacgacctgccccggcatcgggtgcgggtggaaagtttttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttagtagggaagaagggcttcggcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacaggattagataccctggtagtccacgccgtaaacgttgggaactagatgtggggacctttccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagaaatggttgccccgcaaggtcggtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaaggagggagctgtcgaaggtgggatcggtgattaggactaagtcgtaacaaggtagccgtaccggaaggtgcggctggatcacctcctttctaagga

SEQ ID NO: 7538 - DNA, 1530 bp, Reichenbachiella agariperforans
  ref <308>: DATABASE ACCESSION NUMBER: NCBI ACCESSION: NZ_FRAA01000014.1
  ref <309>: DATABASE ENTRY DATE: 2019-04-01
  ref <313>: RELEVANT RESIDUES IN SEQ ID NO: (1)..(1530)
tttattacaatggagagtttgatcctggctcaggatgaacgctagcggcaggcctaatacatgcaagtcgaggggcagcacgagtacttgtacttggtggcgaccggcgcacgggtgcgtaacgcgtatgcaacctacccattactgggagatagcccgaggaaactcggattaataccccatagtattatagattcgcatgatgaaataattaaagatttattggtaatggatgggcatgcgtaccattagttagttggtgaggtaacggctcaccaagactacgatggttagggggcctgagagggtgatcccccacactggtactgagatacggaccagactcctacgggaggcagcagtagggaatattggtcaatggaggagactctgaaccagccatgccgcgtgcaggaagacggccttctgggttgtaaactgcttttgacagggaagaaaacggctatgcgtagctaattgacggtacctgtagaataagcaccggctaactccgtgccagcagccgcggtaatacggagggtgcaagcgttgtccggatttattgggtttaaagggtgcgtaggtggcccattaagtcagtggtgaaattttgcagcttaactgtaaaactgccattgatactggtgggcttgagtattgttgaggcaggcggaatttatgatgtagcggtgaaatgcatagatatcataaagaacaccgatagcgaaggcagcttgctaagcgataactgacactaaggcacgaaagcgtgggtagcgaacaggattagataccctggtagtccacgccgtaaacgatgctcactcgatgtatgcgatattactgtatgcgtccaagcgaaagcgttaagtgagccacctggggagtacgctggcaacagtgaaactcaaaggaattgacgggggtccgcacaagcggtggagcatgtggtttaattcgatgatacgcgaggaaccttacctgggctcgaatgtgagcgctagatttagagatagatcgttcttcggacgtgaaacaaggtgctgcatggctgtcgtcagctcgtgccgtgaggtgttgggttaagtcccgcaacgagcgcaacccctactgttagttgccatcaggttatgctggggactctaacaggactgcctacgcaagtagagaggaaggtggggacgacgtcaagtcatcatggcccttacgcccagggctacacacgtgctacaatggtgcatacagagggtcgcaagctggcaacagcaagccaatctcaaaaagtgcatctcagttcggattggggtctgcaactcgaccccatgaagttggaatcgctagtaatcgcgtatcagcaatgacgcggtgaatacgttcccggaccttgtacacaccgcccgtcaagccatggaagttgggaggacctgaagacggtagctgtaaggcgctgtttagggttataccagtaactagggctaagtcgtaacaaggtagccgtaccggaaggtgcggctggaacacctcctttct

SEQ ID NO: 7539 - DNA, 1529 bp, Reichenbachiella faecimaris
  ref <308>: DATABASE ACCESSION NUMBER: NCBI ACCESSION: NZ_FWYF01000004.1
  ref <309>: DATABASE ENTRY DATE: 2019-04-01
  ref <313>: RELEVANT RESIDUES IN SEQ ID NO: (1)..(1529)
tacaatggagagtttgatcctggctcaggatgaacgctagcggcaggcctaatacatgcaagtcgaggggcagcatgagtacttgtacttgatggcgaccggcgcacgggtgcgtaacgcgtatgcaacctacccataactggaggatagcccggggaaactcggattaatactccatagtattaccagatggcatctgaaggtaattaaagatttattggttatggatgggcatgcgtatcattagttagttggtaaggtaacggcttaccaagacttcgatgattagggggcctgagagggtgatcccccacactggtactgagatacggaccagactcctacgggaggcagcagtagggaatattggtcaatggaggagactctgaaccagccatgccgcgtgcaggaagacggccttctgggttgtaaactgcttttgacagggaagaaaacggctatgcgtagctaactgacggtacctgtagaataagcaccggctaactccgtgccagcagccgcggtaatacggagggtgcaagcgttgtccggatttattgggtttaaagggtacgtaggtggccttataagtcagtggtgaaatgctgcagcttaactgtagcactgccattgatactgtaaggcttgagtgtcgttgaggcaggcggaatttatggtgtagcggtgaaatgcatagataccataaagaacaccgatagcgaaggcagcttgctaagcgacaactgacactaatgtacgaaagcgtgggtagcgaacaggattagataccctggtagtccacgccgtaaacgatgctcactcgatgtatgcgatattactgtatgcgtccaagcgaaagcgttaagtgagccacctggggagtacgctcgcaagagtgaaactcaaaggaattgacgggggtccgcacaagcggtggagcatgtggtttaattcgatgatacgcgaggaaccttacctgggctcgaatgtgagcgcaaggaccagagatggtctgttcttcggacgtgaaacaaggtgctgcatggctgtcgtcagctcgtgccgtgaggtgttgggttaagtcccgcaacgagcgcaacccctactgttagttgccatcaggttaagctggggactctaacaggactgcctacgcaagtagagaggaaggtggggacgacgtcaagtcatcatggcccttacgcccagggctacacacgtgctacaatggtgcatacagagggttgctacacagtaatgtgatgccaatctcaaaaagtgcatctcagttcggattgaggtctgcaactcgacctcatgaagttggaatcgctagtaatcgcgtatcagcaatgacgcggtgaatacgttcccggaccttgtacacaccgcccgtcaagccatggaagttgggtagacctgaagatggttgctgcaaggcgctatttagggtagaaccagtaactggggctaagtcgtaacaaggtagccgtaccggaaggtgcggctggaacacctcctttctggag

SEQ ID NO: 7540 - DNA, 1524 bp, Reichenbachiella sp. MSK19-1
  ref <308>: DATABASE ACCESSION NUMBER: NCBI ACCESSION: NZ_MIER01000013.1
  ref <309>: DATABASE ENTRY DATE: 2019-04-01
  ref <313>: RELEVANT RESIDUES IN SEQ ID NO: (1)..(1524)
acaatggagagtttgatcctggctcaggatgaacgctagcggcaggcctaatacatgcaagtcgaggggcagcacgagtacttgtacttggtggcgaccggcgcacgggtgcgtaacgcgtatgcaacctacccattactgggagatagcccgaggaaactcggattaataccccatagtattatagattcgcatgatgaaataattaaagatttattggtaatggatgggcatgcgtaccattagttagttggtgaggtaacggctcaccaagactacgatggttagggggcctgagagggtgatcccccacactggtactgagatacggaccagactcctacgggaggcagcagtagggaatattggtcaatggaggagactctgaaccagccatgccgcgtgcaggaagacggccttctgggttgtaaactgcttttgacagggaagaaaacggctatgcgtagctaattgacggtacctgtagaataagcaccggctaactccgtgccagcagccgcggtaatacggagggtgcaagcgttgtccggatttattgggtttaaagggtgcgtaggtggcccattaagtcagtggtgaaattttgcagcttaactgtaaaactgccattgatactggtgggcttgagtattgttgaggcaggcggaatttatgatgtagcggtgaaatgcatagatatcataaagaacaccgatagcgaaggcagcttgctaagcgataactgacactaaggcacgaaagcgtgggtagcgaacaggattagataccctggtagtccacgccgtaaacgatgctcactcgatgtatgcgatattactgtatgcgtccaagcgaaagcgttaagtgagccacctggggagtacgctggcaacagtgaaactcaaaggaattgacgggggtccgcacaagcggtggagcatgtggtttaattcgatgatacgcgaggaaccttacctgggctcgaatgtgagcgctagatttagagatagatcgttcttcggacgtgaaacaaggtgctgcatggctgtcgtcagctcgtgccgtgaggtgttgggttaagtcccgcaacgagcgcaacccctactgttagttgccatcaggttatgctggggactctaacaggactgcctacgcaagtagagaggaaggtggggacgacgtcaagtcatcatggcccttacgcccagggctacacacgtgctacaatggtgcatacagagggtcgcaagctggcaacagcaagccaatctcaaaaagtgcatctcagttcggattggggtctgcaactcgaccccatgaagttggaatcgctagtaatcgcgtatcagcaatgacgcggtgaatacgttcccggaccttgtacacaccgcccgtcaagccatggaagttgggaggacctgaagacggtagctgtaaggcgctgtttagggttataccagtaactagggctaagtcgtaacaaggtagccgtaccggaaggtgcggctggaacacctcctttct

SEQ ID NO: 7541 - DNA, 1524 bp, Reichenbachiella versicolor
  ref <308>: DATABASE ACCESSION NUMBER: NCBI ACCESSION: NZ_QFZQ01000020.1
  ref <309>: DATABASE ENTRY DATE: 2019-04-01
  ref <313>: RELEVANT RESIDUES IN SEQ ID NO: (1)..(1524)
acaatggagagtttgatcctggctcaggatgaacgctagcggcaggcctaatacatgcaagtcgaggggcagcacgagtacttgtacttggtggcgaccggcgcacgggtgcgttacgcgtatgcaacctacccataacagggggatagcccagagaaatttggattaataccccatagtactataaagtagcattatttaatagttaaagatttatcggttatggatgggcatgcgtgtcattagctagatggtaaggtaacggcttaccatggcaacgatgactagggggcctgagagggtgatcccccacactggtactgagatacggaccagactcctacgggaggcagcagtagggaatattggtcaatggaggagactctgaaccagccatgccgcgtgcaggaagacggccttatgggttgtaaactgcttttgatagggaagaaaacggctatgcgtagctacttgacggtacctatagaataagcaccggctaactccgtgccagcagccgcggtaatacggagggtgcaagcgttgtccggatttattgggtttaaagggtacgtaggtggcctattaagtcagtggtgaaatgctgcagctcaactgtagcactgccattgatactggtaggcttgagtattgtcgaggcaggcggaatttatgatgtagcggtgaaatgcatagatatcataaagaacaccgatagcgaaggcagcttgctaggcagtaactgacactgatgtacgaaagcgtggggagcgaacaggattagataccctggtagtccacgccgtaaacgatgctcactcgatgtatgcgatacacagtatgcgtccaagcgaaagcgttaagtgagccacctggggagtacgctcgcaagagtgaaactcaaaggaattgacgggggtccgcacaagcggtggagcatgtggtttaattcgatgatacgcgaggaaccttacctgggctcgaatgtgagcgctagattcagagatggatcgttcttcggacgtgaaacaaggtgctgcatggctgtcgtcagctcgtgccgtgaggtgttgggttaagtcccgcaacgagcgcaacccctactgttagttgccatcaggttaagctggggactctaacaggactgcctacgcaagtagagaggaaggtggggacgacgtcaagtcatcatggcccttacgcccagggctacacacgtgctacaatggtgcatacagagggtagcgagctagtaatagtcagccaatctcaaaaagtgcatctcagttcggatcggggtctgcaactcgaccccgtgaagttggaatcgctagtaatcgcgtatcagcaatgacgcggtgaatacgttcccggaccttgtacacaccgcccgtcaagccatggaagttgggtagacctgaagatggttgctttgcagcgctgtttagggtagaactagtaactggggctaagtcgtaacaaggtagccgtaccggaaggtgcggctggaacacctcctttctg

SEQ ID NO: 7542 - DNA, 1500 bp, Reyranella massiliensis
  ref <308>: DATABASE ACCESSION NUMBER: NCBI ACCESSION: NZ_HE997181.1
  ref <309>: DATABASE ENTRY DATE: 2019-04-01
  ref <313>: RELEVANT RESIDUES IN SEQ ID NO: (1)..(1500)
ttaaacttgagagtttgatcctggctcagaacgaacgctggcggcaggcttaacacatgcaagtcgaacgcgtgtagcaatacacgagtggcgcacgggtgagtaacgcgtggatatctgccttttggttcggaataaccccgggaaactggggctaataccggatggttccttcgggataaagatttatcgccaaaagatgagtccgcgtacgattagctagttggtgaggtaatggctcaccaaggcgacgatcgttagctggtctgagaggacgatcagccacactgggactgagacacggcccagactcctacgggaggcagcagtggggaatattggacaatgggggcaaccctgatccagccatgccgcgtgagtgatgaaggccttcgggttgtaaagctcttttggcggggacgatgatgacggtacccgcagaataagccccggctaacttcgtgccagcagccgcggtaagacgaagggggctagcgttgttcggaattactgggcgtaaagcgagtgtaggcggttgtcatagtcaggtgtgaaagccttgagctcaactcaagaaatgcacttgatactgggcgactagaggaccggagaggatagtggaattcccagtgtagtggtgaaatacgtagagattgggaagaacaccagtggcgaaggcggctatctggacggttactgacgctaagactcgaaagcgtggggagcaaacaggattagataccctggtagtccacgccgtaaacgatgggtgctagacgttggcgagcttgctcgtcagtgtcgcagctaacgcgttaagcaccccgcctggggagtacggccgcaaggttgaaactcaaaggaattgacgggggcccgcacaagcggtggagcatgtggttcaattcgacgcaacgcgcagaaccttaccagcccttgacatgggactcgccgggaccagagacggtcccttcggttcggccggagtccgcacaggtgctgcatggctgtcgtcagctcgtgtcgtgagatgttgggttaagtcccgcaacgagcgcaaccctcgtctccagttgccatcaggttatgctgggcactttggagaaactgccggtgacaagccggaggaaggtggggatgacgtcaagtcctcatggcccttacgggctgggctacacacgtgctacaatggcggtgacagtgggatgcgaaggggcgacccggagccgatcccaaaaaaccgtcccagttcggattgcactctgcaactcgagtgcatgaaggtggaatcgctagtaatcgcggatcagcatgccgcggtgaatacgttcccgggccttgtacacaccgcccgtcacgccatgggagttggttctacccgaagatggtgcgctaaccgcaaggaggcagccagccacggtaggatcaatgactggggcgaagtcgtaacaaggtagccgtaggggaacctgcggctggatcacctcctttctaaggaag

SEQ ID NO: 7543 - DNA, 1537 bp, Rhizobacter sp. S-16
  ref <308>: DATABASE ACCESSION NUMBER: NCBI ACCESSION: NZ_QUSW01000019.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgccttacacatgcaagtcgaacggtaacgcggggcaacctggcgacgagtggcgaacgggtgagtaatatatcggaacgtgcccagtagtgggggatagcccggcgaaagccggattaataccgcatacgacctacgggtgaaagcgggggatcgcaagacctcgcgctattggagcggccgatatcagattaggtagttggtggggtaaaagcctaccaagccgacgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaacggctttctctaatacagagggctaatgacggtacctgaagaataagcaccggctaactacgtgccagcagccgcggtaatacgtagggtgcaagcgttaatcggaattactgggcgtaaagcgtgcgcaggcggtcttgcaagacagatgtgaaatccccgggcttaacctgggaactgcatttgtgactgcaaggctggagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaacttgccagagatggcttggtgctcgaaagagaacctggacacaggtgctgcatggccgtcgtcagctcgtgtcgtgagatgttgggttaagtcccgcaacgagcgcaacccttatcattagttgctacgcaagggcactctaatgagactgccggtgacaaaccggaggaaggtggggatgacgtcaggtcatcatggcccttatgggtagggctacacacgtcatacaatggccggtacagagggctgccaacccgcgagggggagctaatctcagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 7544 - DNA, 1503 bp, Rhizobiales bacterium CCH10-E5
  ref <308>: DATABASE ACCESSION NUMBER: NCBI ACCESSION: NZ_LSIG01000231.1
  ref <309>: DATABASE ENTRY DATE: 2019-04-01
  ref <313>: RELEVANT RESIDUES IN SEQ ID NO: (1)..(1503)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataatacagggaaacttgtactaataccggatacgccctttgggggaaagatttatcgccgattgatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggggcgacccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 7545 - DNA, 1500 bp, Rhizobiales bacterium CCH3-A5
  ref <308>: DATABASE ACCESSION NUMBER: NCBI ACCESSION: NZ_LSIB01000190.1
  ref <309>: DATABASE ENTRY DATE: 2019-04-01
  ref <313>: RELEVANT RESIDUES IN SEQ ID NO: (1)..(1500)
caatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggataagcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgaggaacagagatgtacctcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 7546 - DNA, 1503 bp, Rhizobiales bacterium CCH8-D1
  ref <308>: DATABASE ACCESSION NUMBER: NCBI ACCESSION: NZ_LSJR01000005.1
  ref <309>: DATABASE ENTRY DATE: 2019-04-01
  ref <313>: RELEVANT RESIDUES IN SEQ ID NO: (1)..(1503)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataatacagggaaacttgtactaataccggatacgcccttttggggaaagatttatcgccgattgatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggggcgacccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 7547 - DNA, 1490 bp, Rhizobiales bacterium GAS113
  ref <308>: DATABASE ACCESSION NUMBER: NCBI ACCESSION: NZ_FNLG01000001.1
  ref <309>: DATABASE ENTRY DATE: 2019-04-01
  ref <313>: RELEVANT RESIDUES IN SEQ ID NO: (1)..(1490)
ttcaacttgagagtttgatcctggctcagaacgaacgctggcggcaggcttaacacatgcaagtcgaacgccccgcaaggggagtggcagacgggtgagtaacacgtgggaacgtccccctcggttcggaataactcagggaaacttgagctaataccggatacgtccgagaggagaaagatttatcgccgagggatcggcccgcgtctgattagctagttggtgaggtaacggctcaccaaggcgacgatcagtagctggtctgagaggatgaccagccacactgggactgagacacggcccagactcctacgggaggcagcagtggggaatcttggacaatgggcgaaagcctgatccagccatgccgcgtgagtgatgaaggccttagggttgtaaagctctttcgacggggacgataatgacggtacccgtagaagaagccccggctaacttcgtgccagcagccgcggtaatacgaagggggctagcgttgttcggaattactgggcgtaaagcgcacgtaggcggacatttaagtcgggggtgaaagccttgggctcaacccaagaattgccttcgatactgaatgtcttgagaccgggagaggtgagtggaattccgagtgtagaggtgaaattcgtagatattcggaagaacaccagtggcgaaggcggctcactggcccggttctgacgctgaggtgcgaaagcgtggggagcaaacaggattagataccctggtagtccacgccgtaaacgatggatgccagccgttggcaggcttgcttgtcagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcctcgacggtttccagagatggattccttcccgcaagggacgaggacacaggtgctgcatggctgtcgtcagctcgtgtcgtgagatgttgggttaagtcccgcaacgagcgcaaccctcgtcctcagttgccatcattaagttgggcactctgaggagactgccggtgataagccggaggaaggtggggatgacgtcaagtcctcatggcccttacaggctgggctacacacgtgctacaatggtggtgacagagggatgctacggggcgaccctaggcaaatctcaaaaagccatctcagttcagattgcactctgcaactcgagtgcatgaaggtggaatcgctagtaatcgcagatcagcatgctgcggtgaatacgttcccgggccttgtacacaccgcccgtcacaccatgggagttggctttacccgaagacggcgtgctaaccgcaaggaggcagccggccacggtagggtcagcgactggggtgaagtcgtaacaaggtagccgtaggggaacctgcggctggatcacctcctttctaagg

SEQ ID NO: 7548 - DNA, 1490 bp, Rhizobiales bacterium GAS188; identical to SEQ ID NO: 7547
  ref <308>: DATABASE ACCESSION NUMBER: NCBI ACCESSION: NZ_FNSS01000001.1
  ref <309>: DATABASE ENTRY DATE: 2019-04-01
  ref <313>: RELEVANT RESIDUES IN SEQ ID NO: (1)..(1490)

SEQ ID NO: 7549 - DNA, 1491 bp, Rhizobiales bacterium GAS191
  ref <308>: DATABASE ACCESSION NUMBER: NCBI ACCESSION: NZ_FNSX01000001.1
  ref <309>: DATABASE ENTRY DATE: 2019-04-01
  ref <313>: RELEVANT RESIDUES IN SEQ ID NO: (1)..(1491)
attcaacttgagagtttgatcctggctcagaacgaacgctggcggcaggcttaacacatgcaagtcgaacgccccgcaaggggagtggcagacgggtgagtaacacgtgggaacgtccccctcggttcggaataactcagggaaacttgagctaataccggatacgtccgagaggagaaagatttatcgccgagggatcggcccgcgtctgattagctagttggtgaggtaacggctcaccaaggcgacgatcagtagctggtctgagaggatgaccagccacactgggactgagacacggcccagactcctacgggaggcagcagtggggaatcttggacaatgggcgaaagcctgatccagccatgccgcgtgagtgatgaaggccttagggttgtaaagctctttcgacggggacgataatgacggtacccgtagaagaagccccggctaacttcgtgccagcagccgcggtaatacgaagggggctagcgttgttcggaattactgggcgtaaagcgcacgtaggcggacatttaagtcgggggtgaaagccttgggctcaacccaagaattgccttcgatactgaatgtcttgagaccgggagaggtgagtggaattccgagtgtagaggtgaaattcgtagatattcggaagaacaccagtggcgaaggcggctcactggcccggttctgacgctgaggtgcgaaagcgtggggagcaaacaggattagataccctggtagtccacgccgtaaacgatggatgccagccgttggcaggcttgcttgtcagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcctcgacggtttccagagatggattccttcccgcaagggacgaggacacaggtgctgcatggctgtcgtcagctcgtgtcgtgagatgttgggttaagtcccgcaacgagcgcaaccctcgtcctcagttgccatcattaagttgggcactctgaggagactgccggtgataagccggaggaaggtggggatgacgtcaagtcctcatggcccttacaggctgggctacacacgtgctacaatggtggtgacagagggatgctacggggcgaccctaggcaaatctcaaaaagccatctcagttcagattgcactctgcaactcgagtgcatgaaggtggaatcgctagtaatcgcagatcagcatgctgcggtgaatacgttcccgggccttgtacacaccgcccgtcacaccatgggagttggctttacccgaagacggcgtgctaaccgcaaggaggcagccggccacggtagggtcagcgactggggtgaagtcgtaacaaggtagccgtaggggaacctgcggctggatcacctcctttctaagg

SEQ ID NO: 7550 - DNA, 1497 bp, Rhizobiales bacterium KCTC 52945
  ref <308>: DATABASE ACCESSION NUMBER: NCBI ACCESSION: NZ_QKVK01000019.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcaggcttaacacatgcaagtcgaacgggtgcagcaatgcatcagtggcagacgggtgagtaacacgtgggaaccttcctaggggtacggaacaactcagggaaacttgagctaataccgtatacgtccgtgaggagaaagatttatcgcccttagacgggcccgcgtcggattagctagttggtggggtaacggcctaccaaggcgacgatccgtagctgatcttagaggatgatcagccacactgggactgagacacggcccagactcctacgggaggcagcagtggggaatcttggacaatgggcgcaagcctgatccagccatgccgcgtgagtgaagaaggtcttcggattgtaaagctcttttgccagggacgataatgacggtacctggagaataagccccggcaaacttcgtgccagcagccgcggtaatacgaagggggctagcgttgttcggaattactgggcgtaaagcgcacgtaggcgggtcgttaagtcaggggtgaaatcccggagctcaactccggaactgcctttgatactggcgatcttgagatcggaagaggtgagtggaattcccagtgtagaggtgaaattcgtagatattgggaagaacaccagtggcgaaggcggctcactggtccgatactgacgctgaggtgcgaaagcgtggggagcaaacaggattagataccctggtagtccacgccgtaaactatggaagctagccgtcagtcagcttgctgagtggtggcgcagctaacgcattaagcttcccgcctggggagtacggtcgcaagattaaaactcaaaggaattgacgggggcccgcacaagcggtggagcatgtggtttaattcgaagcaacgcgcagaaccttacctacccttgacatgtccagtatgagcatcagagatggagctcttcagttcggctggctggaacacaggtgctgcatggctgtcgtcagctcgtgtcgtgagatgttgggttaagtcccgcaacgagcgcaaccctcgcttctagttgccagcattcagttgggcactctagagggactgccggtgataagccggaggaaggtggggatgacgtcaagtcctcatggcccttacgggtagggctacacacgtgctacaatggcggtgacagtgggcagcgacacagcgatgtgatgctaatcccaaaaagccgtctcagttcagattgcagcctgcaactcggctgcatgaagttggaatcgctagtaatcgctaatcagcaggtagcggtgaatacgttcccgggccttgtacacaccgcccgtcacaccatgggagttggtcatacctgaagacggtgttctaacccgcaagggaggaagccggccacggtgtggtcagcgactggggtgaagtcgtaacaaggtagccgtaggggaacctgcggctggatcacctcctttctaag

SEQ ID NO: 7551 - DNA, 1520 bp, Rhizobiales bacterium YIM 77505
  ref <308>: DATABASE ACCESSION NUMBER: NCBI ACCESSION: NZ_JQNH01000001.1
  ref <309>: DATABASE ENTRY DATE: 2019-04-01
  ref <313>: RELEVANT RESIDUES IN SEQ ID NO: (1)..(1520)
gtgaccagccgagatcagatctctccaacttgagagtttgatcctggctcagagcgaacgctggcggcaggcctaacacatgcaagtcgaacgggcaccttcgggtgtcagtggcagacgggtgagtaacacgtgggaacgtgcccttcagttcggaataacccagggaaacttgggctaataccggatacgcccttcgggggaaagatttatcgctgaaggatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcggcggggacgataatgacggtacccgcagaagaagccccggctaacttcgtgccagcagccgcggtaatacgaagggggctagcgttgctcggaatcactgggcgtaaagggcgcgtaggcggatctctaagtcagaggtgaaagcccaaggcttaaccttggaattgcctttgatactggagatcttgagaccggaagaggtgagtggaactgcgagtgtagaggtgaaattcgtagatattcgcaagaacaccagtggcgaaggcggctcactggtccggttctgacgctgaggcgcgaaagcgtggggagcaaacaggattagataccctggtagtccacgccgtaaacgatggatgctagccgttggccggcttgccggtcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcccttgacatggcaggacggcttccagagatggattccttcccttcggggacctgcacacaggtgctgcatggctgtcgtcagctcgtgtcgtgagatgttgggttaagtcccgcaacgagcgcaaccctcgcccctagttgccatcattcagttgggcactctagggggactgccggtgataagccgagaggaaggtggggatgacgtcaagtcctcatggcccttacgggctgggctacacacgtgctacaatggcggtgacaatgggcagcgaaagggcgacctggagctaatccctaaaagccgtctcagttcagattgcactctgcaactcgagtgcatgaaggcggaatcgctagtaatcgcagatcagcacgctgcggtgaatacgttcccgggccttgtacacaccgcccgtcacaccatgggagttggctttacccgaaggcgctgcgccaacccgcgagggaggcaggcgaccacggtagggtcagcgactggggtgaagtcgtaacaaggtagccgtaggggaacctgcggctggatcacctcctttctaagg

SEQ ID NO: 7552 - DNA, 1481 bp, Rhizobium acidisoli
  ref <308>: DATABASE ACCESSION NUMBER: NCBI ACCESSION: NZ_CP034998.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaatctacccttgactacggaataacgcagggaaacttgtgctaataccgtatgtgtccttcgggagaaagatttatcggtcaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7553 - DNA, 1500 bp, Rhizobium aegyptiacum
  ref <308>: DATABASE ACCESSION NUMBER: NCBI ACCESSION: NZ_LYPM01000037.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7554 - DNA, 1500 bp, Rhizobium alamii
  ref <308>: DATABASE ACCESSION NUMBER: NCBI ACCESSION: NZ_JUHR01000034.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttttggggaaagatttatcggtaagggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7555 - DNA, 1488 bp, Rhizobium album
  ref <308>: DATABASE ACCESSION NUMBER: NCBI ACCESSION: NZ_QFBC01000043.1
  ref <309>: DATABASE ENTRY DATE: 2019-04-01
  ref <313>: RELEVANT RESIDUES IN SEQ ID NO: (1)..(1488)
caacttgagagtttgatcctggctcagaacgaacgctggcggcaggcttaacacatgcaagtcgagcgcatccttcggggtgagcggcagacgggtgagtaacacgtgggaacgtaccctttactacggaatagctccgggaaactggaattaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccggagctcaactccggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacctctagagatagggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7556 - DNA, 1482 bp, Rhizobium altiplani
  ref <308>: DATABASE ACCESSION NUMBER: NCBI ACCESSION: NZ_LNCD01000038.1
  ref <309>: DATABASE ENTRY DATE: 2019-04-01
  ref <313>: RELEVANT RESIDUES IN SEQ ID NO: (1)..(1482)
tcaacatgagagtttgatcctggctcagaacgaacgctggcggcaggcttaacacatgcaagtcgagcgccccgcaaggggagcggcagacgggtgagtaacgcgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagctgcagagatgcagtgttcccttcggggaccggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctccttt

SEQ ID NO: 7557 - DNA, 1481 bp, Rhizobium anhuiense; identical to SEQ ID NO: 7552
  ref <308>: DATABASE ACCESSION NUMBER: NCBI ACCESSION: NZ_ML133552.1
  ref <309>: DATABASE ENTRY DATE: 2019-04-01
  ref <313>: RELEVANT RESIDUES IN SEQ ID NO: (1)..(1481)

SEQ ID NO: 7558 - DNA, 1495 bp, Rhizobium arenae
  ref <308>: DATABASE ACCESSION NUMBER: NCBI ACCESSION: NZ_MOOY01000023.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgaacgccccgcaaggggagtggcagacgggtgagtaacgcgtgggaacatacccatcactacggaataactcagggaaacttgtgctaataccgtatacgaccgagaggtgaaagatttatcggtgatggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaacctcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtctatgaccgggtccagagatggacctttcccttcggggcatagaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7559 - DNA, 1499 bp, Rhizobium bangladeshense
  ref <308>: DATABASE ACCESSION NUMBER: NCBI ACCESSION: NZ_LYPN01000027.1
  ref <309>: DATABASE ENTRY DATE: 2019-04-01
  ref <313>: RELEVANT RESIDUES IN SEQ ID NO: (1)..(1499)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaag

SEQ ID NO: 7560 - DNA, 1500 bp, Rhizobium ecuadorense
  ref <308>: DATABASE ACCESSION NUMBER: NCBI ACCESSION: NZ_LFIO01000095.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7561 - DNA, 1484 bp, Rhizobium etli
  ref <308>: DATABASE ACCESSION NUMBER: NCBI ACCESSION: NZ_QLMF01000047.1
  ref <309>: DATABASE ENTRY DATE: 2019-04-01
  ref <313>: RELEVANT RESIDUES IN SEQ ID NO: (1)..(1484)
caacatgagagtttgatcctggctcagaacgaacgctggcggcaggcttaacacatgcaagtcgaacgccccgcaaggggagtggcagacgggtgagtaacacgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgccaagctacctgcagagatgcagggttcccttcggggacttggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttcta

SEQ ID NO: 7562 - DNA, 1485 bp, Rhizobium fabae
  ref <308>: DATABASE ACCESSION NUMBER: NCBI ACCESSION: NZ_ML133674.1
  ref <309>: DATABASE ENTRY DATE: 2019-04-01
  ref <313>: RELEVANT RESIDUES IN SEQ ID NO: (1)..(1485)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttagggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaa

SEQ ID NO: 7563 - DNA, 1493 bp, Rhizobium flavum
  ref <308>: DATABASE ACCESSION NUMBER: NCBI ACCESSION: NZ_MUXO01000043.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaacgtaccctttactacggaacaactccgggaactggagctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgaatgatgaaggccttagggttgtaaagttctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacaggattagataccctggtagtccacgccgtaaacgatgaatgttagtcgtcgggcagtttactgttcggtgacgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacatccagagatggatggttcccttcggggaccgggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagggggcagcaagcacgcgagtgtgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaaggaagc

SEQ ID NO: 7564 - DNA, 1500 bp, Rhizobium freirei
  ref <308>: DATABASE ACCESSION NUMBER: NCBI ACCESSION: NZ_AQHN01000056.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacctctagagatagggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7565 - DNA, 1500 bp, Rhizobium gallicum
  ref <308>: DATABASE ACCESSION NUMBER: NCBI ACCESSION: NZ_CP017101.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttcgggggaaagatttatcggtaagggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctacagagatgtagggttcccttcggggaccgggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7566 - DNA, 1493 bp, Rhizobium giardinii
  ref <308>: DATABASE ACCESSION NUMBER: NCBI ACCESSION: NZ_KB902704.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7567 - DNA, 1484 bp, Rhizobium grahamii
  ref <308>: DATABASE ACCESSION NUMBER: NCBI ACCESSION: NZ_KZ857262.1
  ref <309>: DATABASE ENTRY DATE: 2019-04-01
  ref <313>: RELEVANT RESIDUES IN SEQ ID NO: (1)..(1484)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcatggaaacgtgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctacttgcagagatgcaaggttcccttcggggaccggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttcta

SEQ ID NO: 7568 - DNA, 1500 bp, Rhizobium hainanense
  ref <308>: DATABASE ACCESSION NUMBER: NCBI ACCESSION: NZ_FMAC01000030.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccctagagatagggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7569 - DNA, 1481 bp, Rhizobium hidalgonense; identical to SEQ ID NO: 7552
  ref <308>: DATABASE ACCESSION NUMBER: NCBI ACCESSION: NZ_SBHU01000118.1
  ref <309>: DATABASE ENTRY DATE: 2019-04-01
  ref <313>: RELEVANT RESIDUES IN SEQ ID NO: (1)..(1481)

SEQ ID NO: 7570 - DNA, 1486 bp, Rhizobium jaguaris
  ref <308>: DATABASE ACCESSION NUMBER: NCBI ACCESSION: NZ_CP032694.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccagagagatttggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7571 - DNA, 1500 bp, Rhizobium laguerreae
  ref <308>: DATABASE ACCESSION NUMBER: NCBI ACCESSION: NZ_MRDM01000018.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctacccttgactacggaataacgcagggaaacttgtgctaataccgtatgtgtccttcgggagaaagatttatcggtcaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7572 - DNA, 1481 bp, Rhizobium leguminosarum
  ref <308>: DATABASE ACCESSION NUMBER: NCBI ACCESSION: NZ_MZMU01000006.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaatctacccttgactacggaataacgcagggaaacttgtgctaataccgtatgtgtccttcgggagaaagatttatcggtcaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7573 - DNA, 1572 bp, Rhizobium leucaenae
  ref <308>: DATABASE ACCESSION NUMBER: NCBI ACCESSION: NZ_LMZF01000103.1
  ref <309>: DATABASE ENTRY DATE: 2019-04-01
  ref <313>: RELEVANT RESIDUES IN SEQ ID NO: (1)..(1572)
ttgaattctcaacatgagagtttgatcctggctcagaacgaacgctggcggcaggcttaacacatgcaagtcgagcgcccctccttcaagcaagcttgaaggatttactccttggaaaagaagatcaagagcgcttctaagaagctttcttgatggaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttaccactagagatagtgggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7574 - DNA, 1494 bp, Rhizobium marinum
  ref <308>: DATABASE ACCESSION NUMBER: NCBI ACCESSION: NZ_JMQK01000051.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgaacgccccgcaaggggagtggcagacgggtgagtaacgcgtgggaatctacccaattctacggaacaacagttggaaacgactgctaataccgtatacgccctacgggggaaagatttatcggaattggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctctgatactgggtatcttgagtatggaagaggtgagtggaattgcgagtgtagaggtgaaattcgtagatattcgcaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgccgctaacgctttaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctacggagacgtggggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaaggaagc

SEQ ID NO: 7575 - DNA, 1492 bp, Rhizobium mesoamericanum
  ref <308>: DATABASE ACCESSION NUMBER: NCBI ACCESSION: NZ_ATYY01000108.1
  ref <309>: DATABASE ENTRY DATE: 2019-04-01
  ref <313>: RELEVANT RESIDUES IN SEQ ID NO: (1)..(1492)
tcaacatgagagtttgatcctggctcagaacgaacgctggcggcaggcttaacacatgcaagtcgagcgccccgcaaggggagcggcagacgggtgagtaacgcgtgggaacgtaccctttgctacggaataacccagggaaacttggactaataccgtatgtgcccttcgggggaaagatttatcggcaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctcggacagctgcagagatgcagtctccacttcggtggccgagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7576 - DNA, 1500 bp, Rhizobium mongolense
  ref <308>: DATABASE ACCESSION NUMBER: NCBI ACCESSION: NZ_ATTQ01000080.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttcgggggaaagatttatcggtaagggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccacctacagagatgtagggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7577 - DNA, 1492 bp, Rhizobium nepotum
  ref <308>: DATABASE ACCESSION NUMBER: NCBI ACCESSION: NZ_JWJH01000079.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaatctaccgtgccctgcggaatagctctgggaaactggaattaataccgcatacgccctacgggggaaagatttatcggggtatgatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7578 - DNA, 1500 bp, Rhizobium oryzae
  ref <308>: DATABASE ACCESSION NUMBER: NCBI ACCESSION: NZ_FXAF01000006.1
  ref <309>: DATABASE ENTRY DATE: 2019-04-01
  ref <313>: RELEVANT RESIDUES IN SEQ ID NO: (1)..(1500)
tcaacttgagagtttgatcctggctcagaacgaacgctggcggcaggcttaacacatgcaagtcgagcgcgtgagcaatcacgagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactggatgtcttgagtgtggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgccctgacatctgcagagatgcagtgtccacttcggtggcagggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgaaggggtgaccccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaagacggtgcgctaaccgcaaggaggcagccggccacggtagggtcagcgactgggggtgaagtcgtaacaaggtagccgtaggggaacctgcggctggatcacctcctttctaaggaagcttttt

SEQ ID NO: 7579 - DNA, 1412 bp, Rhizobium oryziradicis
  ref <308>: DATABASE ACCESSION NUMBER: NCBI ACCESSION: NZ_MKIM01000009.1
  ref <309>: DATABASE ENTRY DATE: 2019-04-01
  ref <313>: RELEVANT RESIDUES IN SEQ ID NO: (1)..(1412)
gagtggcagacgggtgagtaacgcgtgggaatctaccgtaccctacggaatagctctgggaaactggaagtaataccgtatacgcccgcaaggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcgggtatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagttgacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcctacgcccgctacagagatgtagttttcccttcggggacgtagagacaggtgctgcatggctgtcgtcagctcgtgtcgtgagatgttgggttaagtcccgcaacgagcgcaaccctcgcccttagttgccagcattaggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtcgtgcgctaaccgcaaggaggcagcgaaccacggtagggtcagcgactggggtgaagtcgtaacaaggtagccgtaggggaacctgcggctggatcacctcctttctaaggaagc

SEQ ID NO: 7580 - DNA, 1485 bp, Rhizobium phaseoli
  ref <308>: DATABASE ACCESSION NUMBER: NCBI ACCESSION: NZ_ML133630.1
  ref <309>: DATABASE ENTRY DATE: 2019-04-01
  ref <313>: RELEVANT RESIDUES IN SEQ ID NO: (1)..(1485)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaa

SEQ ID NO: 7581 - DNA, 1485 bp, Rhizobium pisi
  ref <308>: DATABASE ACCESSION NUMBER: NCBI ACCESSION: NZ_RJJT01000050.1
  ref <309>: DATABASE ENTRY DATE: 2019-04-01
  ref <313>: RELEVANT RESIDUES IN SEQ ID NO: (1)..(1485)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaa

SEQ ID NO: 7582 - DNA, 1488 bp, Rhizobium rhizosphaerae
  ref <308>: DATABASE ACCESSION NUMBER: NCBI ACCESSION: NZ_MSPX01000039.1
  ref <309>: DATABASE ENTRY DATE: 2019-04-01
  ref <313>: RELEVANT RESIDUES IN SEQ ID NO: (1)..(1488)
tcaacatgagagtttgatcctggctcagaacgaacgctggcggcaggcttaacacatgcaagtcgagcgccccgcaaggggagcggcagacgggtgagtaacgcgtgggaacgtaccctttactacggaatagctccgggaaactggaattaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtgtggaagaggtgagtggaattgcgagtgtagaggtgaaattcgtagatattcgcaggaacaccagtggcgaaggcggctcactggtccacaactgacgctgaggtgcgaaagcgtggggagcaaacaggattagataccctggtagtccacgccgtaaacgatgaatgctagccgtcgggcagtttactgttcggtggcgccgctaacgctttaagcattccgcctggggagtacggtcgcaagattaaaactcaaaggaattgacgggggcccgcacaagcggtggagcatgtggtttaattcgaagcaacgcgcagaaccttaccagcccttgacatcccgagaccggtccagagatggactttccacttcggtggctcggagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttctaagg

SEQ ID NO: 7583 - DNA, 1491 bp, Rhizobium selenitireducens
  ref <308>: DATABASE ACCESSION NUMBER: NCBI ACCESSION: NZ_UEYP01000005.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctaccgtaccctacggaataacgcatggaaacgtgtgctaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatctcgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagcttgctgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcagtggagacattgtccttcagttcggctggccccagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7584 - DNA, 1481 bp, Rhizobium sophoriradicis
  ref <308>: DATABASE ACCESSION NUMBER: NCBI ACCESSION: NZ_RQIH01000042.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggcgacctgcagagatgcagggttcccttcggggaccgggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7585 - DNA, 1486 bp, Rhizobium sp. 11515TR
  ref <308>: DATABASE ACCESSION NUMBER: NCBI ACCESSION: NZ_CP022998.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccctttagggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgtgttacccagagagatttggggtccacttcggtggcgcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7586 - DNA, 1489 bp, Rhizobium sp. 24NR
  ref <308>: DATABASE ACCESSION NUMBER: NCBI ACCESSION: NZ_SBIP01000010.1
  ref <309>: DATABASE ENTRY DATE: 2019-04-01
  ref <313>: RELEVANT RESIDUES IN SEQ ID NO: (1)..(1489)
tcaacttgagagtttgatcctggctcagaacgaacgctggcggcaggcttaacacatgcaagtcgagcgccttggcaacaaggagcggcagacgggtgagtaacgcgtgggaatctacccaaccctacggaacaactccgggaaactggagctaataccgtatacgcccttatggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccataactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccatgaccggtagagagatttacctttcccttcggggacatggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7587 - DNA, 1500 bp, Rhizobium sp. 2MFCol3.1
  ref <308>: DATABASE ACCESSION NUMBER: NCBI ACCESSION: NZ_KB898392.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgaacgccccgcaaggggagtggcagacgggtgagtaacacgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgccaagttcgctacagagatgtagttttcccttcggggacttggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7588 - DNA, 1500 bp, Rhizobium sp. 42MFCr.1
  ref <308>: DATABASE ACCESSION NUMBER: NCBI ACCESSION: NZ_KB897817.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctacctgcagagatgcagggttcccttcggggaccggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7589 - DNA, 1495 bp, Rhizobium sp. 58
  ref <308>: DATABASE ACCESSION NUMBER: NCBI ACCESSION: NZ_LSRO01000156.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgccccgcaaggggagcggcagacgggtgagtaacgcgtgggaatctacccatctctacggaacaacagttggaaacgactgctaataccgtatacgcccttagggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgaatgatgaaggccttagggttgtaaagttctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcggtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccttcgcccttagttgccagcattcagttgggcactctaaggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaagg

SEQ ID NO: 7590 - DNA, 1494 bp, Rhizobium sp. AAP116; identical to SEQ ID NO: 1213
  ref <308>: DATABASE ACCESSION NUMBER: NCBI ACCESSION: NZ_LJIB01000040.1
  ref <309>: DATABASE ENTRY DATE: 2019-04-01
  ref <313>: RELEVANT RESIDUES IN SEQ ID NO: (1)..(1494)

SEQ ID NO: 7591 - DNA, 1494 bp, Rhizobium sp. AAP43
  ref <308>: DATABASE ACCESSION NUMBER: NCBI ACCESSION: NZ_LJHS01000013.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgccccgcaaggggagcggcagacgggtgagtaacgcgtgggaatctaccgagccctacggaataacgcatggaaacgtgtgctaataccgtatacgccctacgggggaaagatttatcggggtttgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgacgaagataatgacggtagtcggagaagaagccccggctaacttcgtgccagcagccgcggtaatacgaagggggctagcgttgttcggaattactgggcgtaaagcgcatgtaggcggatatttaagtcaggggtgaaatcccagagctcaactctggaactgcctttgatactgggtatctcgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtctactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtatccttcagttcggctggacccaagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccagcaatggaggcagctaaccacggtagggtcagcgactggggtgaagtcgtaacaaggtagccgtaggggaacctgcggctggatcacctcctttctaagg

SEQ ID NO: 7592 - DNA, 1500 bp, Rhizobium sp. AC27 96
  ref <308>: DATABASE ACCESSION NUMBER: NCBI ACCESSION: NZ_LXKN01000053.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttaccagtagagatattgggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7593 - DNA, 1500 bp, Rhizobium sp. AC44 96
  ref <308>: DATABASE ACCESSION NUMBER: NCBI ACCESSION: NZ_LXKO01000033.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtacccttttctacggaataacgcatggaaacgtgtgctaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctacttgcagagatgcaaggttcccttcggggaccggaacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7594 - DNA, 1491 bp, Rhizobium sp. AG855
  ref <308>: DATABASE ACCESSION NUMBER: NCBI ACCESSION: NZ_RAQG01000011.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtatccttcagttcggctggacccaagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacggtgacgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7595 - DNA, 1491 bp, Rhizobium sp. AN5; identical to SEQ ID NO: 1214
  ref <308>: DATABASE ACCESSION NUMBER: NCBI ACCESSION: NZ_OCMJ01000004.1
  ref <309>: DATABASE ENTRY DATE: 2019-04-01
  ref <313>: RELEVANT RESIDUES IN SEQ ID NO: (1)..(1491)

SEQ ID NO: 7596 - DNA, 1491 bp, Rhizobium sp. AN6A; identical to SEQ ID NO: 1214
  ref <308>: DATABASE ACCESSION NUMBER: NCBI ACCESSION: NZ_OCNC01000004.1
  ref <309>: DATABASE ENTRY DATE: 2019-04-01
  ref <313>: RELEVANT RESIDUES IN SEQ ID NO: (1)..(1491)

SEQ ID NO: 7597 - DNA, 1500 bp, Rhizobium sp. AP16; identical to SEQ ID NO: 1194
  ref <308>: DATABASE ACCESSION NUMBER: NCBI ACCESSION: NZ_AJVM01000087.1
  ref <309>: DATABASE ENTRY DATE: 2019-04-01
  ref <313>: RELEVANT RESIDUES IN SEQ ID NO: (1)..(1500)

SEQ ID NO: 7598 - DNA, 1481 bp, Rhizobium sp. C16
  ref <308>: DATABASE ACCESSION NUMBER: NCBI ACCESSION: NZ_ML133827.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7599 - DNA, 1486 bp, Rhizobium sp. CCGE531
  ref <308>: DATABASE ACCESSION NUMBER: NCBI ACCESSION: NZ_CP032684.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccttacggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgtgttacccagagagatttggggtccacttcggtggcgcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7600 - DNA, 1486 bp, Rhizobium sp. CCGE532; identical to SEQ ID NO: 7599
  ref <308>: DATABASE ACCESSION NUMBER: NCBI ACCESSION: NZ_CP032689.1
  ref <309>: DATABASE ENTRY DATE: 2019-04-01
  ref <313>: RELEVANT RESIDUES IN SEQ ID NO: (1)..(1486)

SEQ ID NO: 7601 - DNA, 1500 bp, Rhizobium sp. CCGE 510; identical to SEQ ID NO: 7571
  ref <308>: DATABASE ACCESSION NUMBER: NCBI ACCESSION: NZ_AEYF01000094.1
  ref <309>: DATABASE ENTRY DATE: 2019-04-01
  ref <313>: RELEVANT RESIDUES IN SEQ ID NO: (1)..(1500)

SEQ ID NO: 7602 - DNA, 1500 bp, Rhizobium sp. CF048
  ref <308>: DATABASE ACCESSION NUMBER: NCBI ACCESSION: NZ_JUHN01000043.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcatggaaacgtgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7603 - DNA, 1492 bp, Rhizobium sp. CF080
  ref <308>: DATABASE ACCESSION NUMBER: NCBI ACCESSION: NZ_AKKC02000008.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7604 - DNA, 1493 bp, Rhizobium sp. CF097
  ref <308>: DATABASE ACCESSION NUMBER: NCBI ACCESSION: NZ_JQMF01000050.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttttggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7605 - DNA, 1500 bp, Rhizobium sp. CF122
  ref <308>: DATABASE ACCESSION NUMBER: NCBI ACCESSION: NZ_AKKA01000125.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacccagggaaacttggactaataccgtatgagcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7606 - DNA, 971 bp, Rhizobium sp. CF258
  ref <308>: DATABASE ACCESSION NUMBER: NCBI ACCESSION: NZ_JQME01000032.1
  ref <309>: DATABASE ENTRY DATE: 2019-04-01
  ref <313>: RELEVANT RESIDUES IN SEQ ID NO: (1)..(971)
cgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7607 - DNA, 1492 bp, Rhizobium sp. CF394
  ref <308>: DATABASE ACCESSION NUMBER: NCBI ACCESSION: NZ_JQKY01000049.1
  ref <309>: DATABASE ENTRY DATE: 2019-04-01
  ref <313>: RELEVANT RESIDUES IN SEQ ID NO: (1)..(1492)
tcaacatgagagtttgatcctggctcagaacgaacgctggcggcaggcttaacacatgcaagtcgagcgccccgcaaggggagcggcagacgggtgagtaacgcgtgggaacgtacccttttctacggaataacgcatggaaacgtgtgctaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctcggacagctgcagagatgcagtctccacttcggtggccgagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7608 - DNA, 1481 bp, Rhizobium sp. CIAT894
  ref <308>: DATABASE ACCESSION NUMBER: NCBI ACCESSION: NZ_CP020947.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggcgacctgcagagatgcagggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7609 - DNA, 1492 bp, Rhizobium sp. GHKF11; identical to SEQ ID NO: 1185
  ref <308>: DATABASE ACCESSION NUMBER: NCBI ACCESSION: NZ_LVFG01000012.1
  ref <309>: DATABASE ENTRY DATE: 2019-04-01
  ref <313>: RELEVANT RESIDUES IN SEQ ID NO: (1)..(1492)

SEQ ID NO: 7610 - DNA, 1481 bp, Rhizobium sp. H4; identical to SEQ ID NO: 7584
  ref <308>: DATABASE ACCESSION NUMBER: NCBI ACCESSION: NZ_PSOW01000037.1
  ref <309>: DATABASE ENTRY DATE: 2019-04-01
  ref <313>: RELEVANT RESIDUES IN SEQ ID NO: (1)..(1481)

SEQ ID NO: 7611 - DNA, 1492 bp, Rhizobium sp. H41; identical to SEQ ID NO: 1185
  ref <308>: DATABASE ACCESSION NUMBER: NCBI ACCESSION: NZ_JPFJ01000113.1
  ref <309>: DATABASE ENTRY DATE: 2019-04-01
  ref <313>: RELEVANT RESIDUES IN SEQ ID NO: (1)..(1492)

SEQ ID NO: 7612 - DNA, 1397 bp, Rhizobium sp. IBUN
  ref <308>: DATABASE ACCESSION NUMBER: NCBI ACCESSION: NZ_AZNV01000098.1
  ref <309>: DATABASE ENTRY DATE: 2019-04-01
  ref <313>: RELEVANT RESIDUES IN SEQ ID NO: (1)..(1397)
gagtaacgcgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagctgcagagatgcagtgttcccttcggggaccggaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7613 - DNA, 1492 bp, Rhizobium sp. IRBG74; identical to SEQ ID NO: 1185
  ref <308>: DATABASE ACCESSION NUMBER: NCBI ACCESSION: NC_022535.1
  ref <309>: DATABASE ENTRY DATE: 2019-04-01
  ref <313>: RELEVANT RESIDUES IN SEQ ID NO: (1)..(1492)

SEQ ID NO: 7614 - DNA, 1487 bp, Rhizobium sp. JAB6
  ref <308>: DATABASE ACCESSION NUMBER: NCBI ACCESSION: NZ_PYJQ01000001.1
  ref <309>: DATABASE ENTRY DATE: 2019-04-01
  ref <313>: RELEVANT RESIDUES IN SEQ ID NO: (1)..(1487)
tcaacatgagagtttgatcctggctcagaacgaacgctggcggcaggcttaacacatgcaagtcgagcgccccttacggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgtgttacccgtagagatatggggtccacttcggtggcgcggagacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7615 - DNA, 1493 bp, Rhizobium sp. KAs 5 22
  ref <308>: DATABASE ACCESSION NUMBER: NCBI ACCESSION: NZ_PKSP01000010.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaatctaccgagccctacggaataacgcatggaaacgtgtgctaataccgtatacgccctacgggggaaagatttatcggggtttgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagcttgctgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcagtggagacattgtccttcagttcggctggccccagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaag

SEQ ID NO: 7616 - DNA, 1481 bp, Rhizobium sp. Kim5
  ref <308>: DATABASE ACCESSION NUMBER: NCBI ACCESSION: NZ_CP021124.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggcgacctgcagagatgcagggttcccttcggggaccgggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgaagtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7617 - DNA, 1502 bp, Rhizobium sp. LC145
  ref <308>: DATABASE ACCESSION NUMBER: NCBI ACCESSION: NZ_LBHV01000008.1
  ref <309>: DATABASE ENTRY DATE: 2019-04-01
  ref <313>: RELEVANT RESIDUES IN SEQ ID NO: (1)..(1502)
ttgaattctcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgccctttgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaacctcggaactgcctttgatactgggtgtcttgagtgtggaagaggtaagtggaattgcgagtgtagaggtgaaattcgtagatattcgcaggaacaccagtggcgaaggcggcttactggtccacaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaacccgcaaggggggcagctaaccacggtagggtcagcgactggggtgaagtcgtaacaaggtagccgtaggggaacctgcggctggatcacctcctttctaaggaagc

SEQ ID NO: 7618 - DNA, 670 bp, Rhizobium sp. LMB-1
  ref <308>: DATABASE ACCESSION NUMBER: NCBI ACCESSION: NZ_JZUD01000065.1
  ref <309>: DATABASE ENTRY DATE: 2019-04-01
  ref <313>: RELEVANT RESIDUES IN SEQ ID NO: (1)..(670)
cctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7619 - DNA, 1496 bp, Rhizobium sp. Leaf155
  ref <308>: DATABASE ACCESSION NUMBER: NCBI ACCESSION: NZ_LMOT01000007.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgccccgcaaggggagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaaggaagc

SEQ ID NO: 7620 - DNA, 1496 bp, Rhizobium sp. Leaf202
  ref <308>: DATABASE ACCESSION NUMBER: NCBI ACCESSION: NZ_LMKD01000008.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaaggaagc

SEQ ID NO: 7621 - DNA, 1492 bp, Rhizobium sp. Leaf262
  ref <308>: DATABASE ACCESSION NUMBER: NCBI ACCESSION: NZ_LMMM01000015.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagttgactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 7622 - DNA, 1500 bp, Rhizobium sp. Leaf306
  ref <308>: DATABASE ACCESSION NUMBER: NCBI ACCESSION: NZ_LMNX01000001.1
  ref <309>: DATABASE ENTRY DATE: 2019-04-01
  ref <313>: RELEVANT RESIDUES IN SEQ ID NO: (1)..(1500)
ttgaattctcaacttgagagtttgatcctggctcagaacgaacgctggcggcaggcttaacacatgcaagtcgaacgctccgcaaggagagtggcagacgggtgagtaacacgtgggaacgtaccctttactacggaacaactccgggaaactggagctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctatccgcagagatgtggagttcccttcggggaccggagcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgaaggagcgatcctgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7623 - DNA, 1500 bp, Rhizobium sp. Leaf321; identical to SEQ ID NO: 7622
  ref <308>: DATABASE ACCESSION NUMBER: NCBI ACCESSION: NZ_LMOF01000011.1
  ref <309>: DATABASE ENTRY DATE: 2019-04-01
  ref <313>: RELEVANT RESIDUES IN SEQ ID NO: (1)..(1500)

SEQ ID NO: 7624 - DNA, 1521 bp, Rhizobium sp. Leaf341
  ref <308>: DATABASE ACCESSION NUMBER: NCBI ACCESSION: NZ_LMPE01000001.1
  ref <309>: DATABASE ENTRY DATE: 2019-04-01
  ref <313>: RELEVANT RESIDUES IN SEQ ID NO: (1)..(1521)
ttgaattctcaacttgagagtttgatcctggctcagaacgaacgctggcggcaggcttaacacatgcaagtcgagcgcatccttcggggtgagcggcagacgggtgagtaacgcgtgggaatctaccttttgctacggaatagctccgggaaactggaattaataccgtatgtgccctttgacggtggacgttggaggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctatccagagagatttggagttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaactcagcaatgagaggcaggcgaccacggtagggtcagcgactggggtgaagtcgtaacaaggtagccgtaggggaacctgcggctggatcacctcctttctaaggaagc

SEQ ID NO: 7625 - DNA, 1511 bp, Rhizobium sp. Leaf371
  ref <308>: DATABASE ACCESSION NUMBER: NCBI ACCESSION: NZ_LMQB01000023.1
  ref <309>: DATABASE ENTRY DATE: 2019-04-01
  ref <313>: RELEVANT RESIDUES IN SEQ ID NO: (1)..(1511)
tcaacttgagagtttgatcctggctcagaacgaacgctggcggcaggcttaacacatgcaagtcgagcgcatccttcggggtgagcggcagacgggtgagtaacgcgtgggaatctaccttttgctacggaatagctccgggaaactggaattaataccgtatgtgctctttggcggtggacgctttagaggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctatccagagagatttggagttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaacccgtaagggaggcaggcgaccacggtagggtcagcgactggggtgaagtcgtaacaaggtagccgtaggggaacctgcggctggatcacctcctttctaaggaagc

SEQ ID NO: 7626 - DNA, 1521 bp, Rhizobium sp. Leaf383; identical to SEQ ID NO: 7624
  ref <308>: DATABASE ACCESSION NUMBER: NCBI ACCESSION: NZ_LMQD01000001.1
  ref <309>: DATABASE ENTRY DATE: 2019-04-01
  ref <313>: RELEVANT RESIDUES IN SEQ ID NO: (1)..(1521)

SEQ ID NO: 7627 - DNA, 1521 bp, Rhizobium sp. Leaf384
  ref <308>: DATABASE ACCESSION NUMBER: NCBI ACCESSION: NZ_LMQE01000001.1
  ref <309>: DATABASE ENTRY DATE: 2019-04-01
  ref <313>: RELEVANT RESIDUES IN SEQ ID NO: (1)..(1521)
ttgaattctcaacttgagagtttgatcctggctcagaacgaacgctggcggcaggcttaacacatgcaagtcgagcgcatccttcggggtgagcggcagacgggtgagtaacgcgtgggaatctaccttttgctacggaatagctccgggaaactggaattaataccgtatgtgccctttgacggtggacgttggaggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggcyttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctatccagagagatttggagttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaactcagcaatgagaggcaggcgaccacggtagggtcagcgactggggtgaagtcgtaacaaggtagccgtaggggaacctgcggctggatcacctcctttctaaggaagc

SEQ ID NO: 7628 - DNA, 1493 bp, Rhizobium sp. Leaf386
  ref <308>: DATABASE ACCESSION NUMBER: NCBI ACCESSION: NZ_LMQF01000049.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgaacgccccgcaaggggagtggcagacgggtgagtaacgcgtgggaatctacccaactctacggaataactcagggaaacttgtgctaataccgtatacgcccttcgggggaaagatttatcggagttggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7629 - DNA, 1493 bp, Rhizobium sp. Leaf391; identical to SEQ ID NO: 7628
  ref <308>: DATABASE ACCESSION NUMBER: NCBI ACCESSION: NZ_LMQG01000040.1
  ref <309>: DATABASE ENTRY DATE: 2019-04-01
  ref <313>: RELEVANT RESIDUES IN SEQ ID NO: (1)..(1493)

SEQ ID NO: 7630 - DNA, 1493 bp, Rhizobium sp. Leaf453; identical to SEQ ID NO: 7628
  ref <308>: DATABASE ACCESSION NUMBER: NCBI ACCESSION: NZ_LMRG01000027.1
  ref <309>: DATABASE ENTRY DATE: 2019-04-01
  ref <313>: RELEVANT RESIDUES IN SEQ ID NO: (1)..(1493)

SEQ ID NO: 7631 - DNA, 1496 bp, Rhizobium sp. Leaf68; identical to SEQ ID NO: 7620
  ref <308>: DATABASE ACCESSION NUMBER: NCBI ACCESSION: NZ_LMLQ01000011.1
  ref <309>: DATABASE ENTRY DATE: 2019-04-01
  ref <313>: RELEVANT RESIDUES IN SEQ ID NO: (1)..(1496)

SEQ ID NO: 7632 - DNA, 1500 bp, Rhizobium sp. N113; identical to SEQ ID NO: 7560
  ref <308>: DATABASE ACCESSION NUMBER: NCBI ACCESSION: NZ_CP013517.1
  ref <309>: DATABASE ENTRY DATE: 2019-04-01
  ref <313>: RELEVANT RESIDUES IN SEQ ID NO: (1)..(1500)

SEQ ID NO: 7633 - DNA, 1500 bp, Rhizobium sp. N1314
  ref <308>: DATABASE ACCESSION NUMBER: NCBI ACCESSION: NZ_CP013511.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7634 - DNA, 1500 bp, Rhizobium sp. N1341; identical to SEQ ID NO: 7560
  ref <308>: DATABASE ACCESSION NUMBER: NCBI ACCESSION: NZ_CP013505.1
  ref <309>: DATABASE ENTRY DATE: 2019-04-01
  ref <313>: RELEVANT RESIDUES IN SEQ ID NO: (1)..(1500)

SEQ ID NO: 7635 - DNA, 1500 bp, Rhizobium sp. N324; identical to SEQ ID NO: 7560
  ref <308>: DATABASE ACCESSION NUMBER: NCBI ACCESSION: NZ_CP013630.1
  ref <309>: DATABASE ENTRY DATE: 2019-04-01
  ref <313>: RELEVANT RESIDUES IN SEQ ID NO: (1)..(1500)

SEQ ID NO: 7636 - DNA, 1500 bp, Rhizobium sp. N541; identical to SEQ ID NO: 7560
  ref <308>: DATABASE ACCESSION NUMBER: NCBI ACCESSION: NZ_CP013636.1
  ref <309>: DATABASE ENTRY DATE: 2019-04-01
  ref <313>: RELEVANT RESIDUES IN SEQ ID NO: (1)..(1500)

SEQ ID NO: 7637 - DNA, 1500 bp, Rhizobium sp. N621; identical to SEQ ID NO: 7560
  ref <308>: DATABASE ACCESSION NUMBER: NCBI ACCESSION: NZ_CP013495.1
  ref <309>: DATABASE ENTRY DATE: 2019-04-01
  ref <313>: RELEVANT RESIDUES IN SEQ ID NO: (1)..(1500)

SEQ ID NO: 7638 - DNA, 1500 bp, Rhizobium sp. N6212; identical to SEQ ID NO: 7560
  ref <308>: DATABASE ACCESSION NUMBER: NCBI ACCESSION: NZ_CP013490.1
  ref <309>: DATABASE ENTRY DATE: 2019-04-01
  ref <313>: RELEVANT RESIDUES IN SEQ ID NO: (1)..(1500)

SEQ ID NO: 7639 - DNA, 1500 bp, Rhizobium sp. N731; identical to SEQ ID NO: 7633
  ref <308>: DATABASE ACCESSION NUMBER: NCBI ACCESSION: NZ_CP013601.1
  ref <309>: DATABASE ENTRY DATE: 2019-04-01
  ref <313>: RELEVANT RESIDUES IN SEQ ID NO: (1)..(1500)

SEQ ID NO: 7640 - DNA, 1500 bp, Rhizobium sp. N741; identical to SEQ ID NO: 7560
  ref <308>: DATABASE ACCESSION NUMBER: NCBI ACCESSION: NZ_CP013595.1
  ref <309>: DATABASE ENTRY DATE: 2019-04-01
  ref <313>: RELEVANT RESIDUES IN SEQ ID NO: (1)..(1500)

SEQ ID NO: 7641 - DNA, 1500 bp, Rhizobium sp. N871; identical to SEQ ID NO: 7560
  ref <308>: DATABASE ACCESSION NUMBER: NCBI ACCESSION: NZ_CP013590.1
  ref <309>: DATABASE ENTRY DATE: 2019-04-01
  ref <313>: RELEVANT RESIDUES IN SEQ ID NO: (1)..(1500)

SEQ ID NO: 7642 - DNA, 1500 bp, Rhizobium sp. N941; identical to SEQ ID NO: 7560
  ref <308>: DATABASE ACCESSION NUMBER: NCBI ACCESSION: NZ_CP013643.1
  ref <309>: DATABASE ENTRY DATE: 2019-04-01
  ref <313>: RELEVANT RESIDUES IN SEQ ID NO: (1)..(1500)

SEQ ID NO: 7643 - DNA, 1487 bp, Rhizobium sp. NAU-18
  ref <308>: DATABASE ACCESSION NUMBER: NCBI ACCESSION: NZ_QJKM01000048.1
  ref <309>: DATABASE ENTRY DATE: 2019-04-01
  ref <313>: RELEVANT RESIDUES IN SEQ ID NO: (1)..(1487)
tcaacttgagagtttgatcctggctcagaacgaacgctggcggcaggcttaacacatgcaagtcgagcgcgtagcaatacgagcggcagacgggtgagtaacgcgtgggaatctacccaaccctacggaacaactccgggaaactggagctaataccgtatacgcccttagggggaaagatttatcggggttggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggggaagataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtgtggaagaggtcagtggaattgcgagtgtagaggtgaaattcgtagatattcgcaggaacaccagtggcgaaggcggctgactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgaccggtagagagatttacctttcccttcggggacgcagagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaagacggtgcgctaaccgcaaggaggcagccggccacggtagggtcagcgactggggtgaagtcgtaacaaggtagccgtaggggaacctgcggctggatcacctcctttctaag

SEQ ID NO: 7644 - DNA, 1487 bp, Rhizobium sp. NFR17
  ref <308>: DATABASE ACCESSION NUMBER: NCBI ACCESSION: NZ_QLTG01000047.1
  ref <309>: DATABASE ENTRY DATE: 2019-04-01
  ref <313>: RELEVANT RESIDUES IN SEQ ID NO: (1)..(1487)
tcaacatgagagtttgatcctggctcagaacgaacgctggcggcaggcttaacacatgcaagtcgagcgccccgcaaggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7645 - DNA, 1493 bp, Rhizobium sp. NT-26
  ref <308>: DATABASE ACCESSION NUMBER: NCBI ACCESSION: NZ_FO082820.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaacgtaccctttactacggaacaactccgggaaactggagctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgaatgatgaaggccttagggttgtaaagttctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacaggattagataccctggtagtccacgccgtaaacgatgaatgttagtcgtcgggcagtttactgttcggtgacgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacatccagagatggatggttcccttcggggaccgggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaaggaag

SEQ ID NO: 7646 - DNA, 1500 bp, Rhizobium sp. NXC14
  ref <308>: DATABASE ACCESSION NUMBER: NCBI ACCESSION: NZ_CP021030.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcattaggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7647 - DNA, 1486 bp, Rhizobium sp. NXC24
  ref <308>: DATABASE ACCESSION NUMBER: NCBI ACCESSION: NZ_CP024311.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccttagagatagggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7648 - DNA, 1500 bp, Rhizobium sp. OK494
  ref <308>: DATABASE ACCESSION NUMBER: NCBI ACCESSION: NZ_JQLA01000064.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7649 - DNA, 1493 bp, Rhizobium sp. OK665
  ref <308>: DATABASE ACCESSION NUMBER: NCBI ACCESSION: NZ_JQJO01000031.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgaacgccccgcaaggggagtggcagacgggtgagtaacgcgtgggaacatacccaactctacggaataactcagggaaacttgtgctaataccgtatacgcccttcgggggaaagatttatcggagttggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7650 - DNA, 1500 bp, Rhizobium sp. OV201; identical to SEQ ID NO: 7602
  ref <308>: DATABASE ACCESSION NUMBER: NCBI ACCESSION: NZ_JQJZ01000057.1
  ref <309>: DATABASE ENTRY DATE: 2019-04-01
  ref <313>: RELEVANT RESIDUES IN SEQ ID NO: (1)..(1500)

SEQ ID NO: 7651 - DNA, 1544 bp, Rhizobium sp. P44RR-XXIV
  ref <308>: DATABASE ACCESSION NUMBER: NCBI ACCESSION: NZ_MPVZ01000043.1
  ref <309>: DATABASE ENTRY DATE: 2019-04-01
  ref <313>: RELEVANT RESIDUES IN SEQ ID NO: (1)..(1544)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaatcgaaga

SEQ ID NO: 7652 - DNA, 1492 bp, Rhizobium sp. PDO1-076
  ref <308>: DATABASE ACCESSION NUMBER: NCBI ACCESSION: NZ_AHZC01000107.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaatctaccgtaccctacggaataacgcatggaaacgtgtgctaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagttgactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtaaccttcagttcggctggacccaagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggcgacgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7653 - DNA, 1498 bp, Rhizobium sp. PP-CC-3A-592
  ref <308>: DATABASE ACCESSION NUMBER: NCBI ACCESSION: NZ_QJSR01000021.1
  ref <309>: DATABASE ENTRY DATE: 2019-04-01
  ref <313>: RELEVANT RESIDUES IN SEQ ID NO: (1)..(1498)
caacttgagagtttgatcctggctcagaacgaacgctggcggcaggcttaacacatgcaagtcgagcgccccgcaaggggagcggcagacgggtgagtaacgcgtgggaatctaccttttgctacggaatagctccgggaaactggaattaataccgtatgtgccctttgatggtggacattttaggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagctccagagatggagtgttcccttcggggaccggagcacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaacccgtaagggaggcaggcgaccacggtagggtcagcgactggggtgaagtcgtaacaaggtagccgtaggggaacctgcggctggatcacctccttt

SEQ ID NO: 7654 - DNA, 1498 bp, Rhizobium sp. PP-F2F-G20b
  ref <308>: DATABASE ACCESSION NUMBER: NCBI ACCESSION: NZ_QJSV01000039.1
  ref <309>: DATABASE ENTRY DATE: 2019-04-01
  ref <313>: RELEVANT RESIDUES IN SEQ ID NO: (1)..(1498)
caacttgagagtttgatcctggctcagaacgaacgctggcggcaggcttaacacatgcaagtcgagcgccccgcaaggggagcggcagacgggtgagtaacgcgtgggaatctaccttttgctacggaatagctccgggaaactggaattaataccgtatgtgccctttgatggtggacattttaggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagctccagagatggagtgttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctccttt

SEQ ID NO: 7655 - DNA, 1498 bp, Rhizobium sp. PP-F2F-G38
  ref <308>: DATABASE ACCESSION NUMBER: NCBI ACCESSION: NZ_QJTH01000042.1
  ref <309>: DATABASE ENTRY DATE: 2019-04-01
  ref <313>: RELEVANT RESIDUES IN SEQ ID NO: (1)..(1498)
caacttgagagtttgatcctggctcagaacgaacgctggcggcaggcttaacacatgcaagtcgagcgccccgcaaggggagcggcagacgggtgagtaacgcgtgggaatctaccttttgctacggaatagctccgggaaactggaattaataccgtatgtgccctttggtggtggacatcaggggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagccgcagagatgcggtgttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctccttt

SEQ ID NO: 7656 - DNA, 1498 bp, Rhizobium sp. PP-WC-1G-195; identical to SEQ ID NO: 7655
  ref <308>: DATABASE ACCESSION NUMBER: NCBI ACCESSION: NZ_QJSS01000041.1
  ref <309>: DATABASE ENTRY DATE: 2019-04-01
  ref <313>: RELEVANT RESIDUES IN SEQ ID NO: (1)..(1498)

SEQ ID NO: 7657 - DNA, 1486 bp, Rhizobium sp. Pop5
  ref <308>: DATABASE ACCESSION NUMBER: NCBI ACCESSION: NZ_AMCP01001078.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccagagagatttggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7658 - DNA, 1485 bp, Rhizobium sp. RMa-01
  ref <308>: DATABASE ACCESSION NUMBER: NCBI ACCESSION: NZ_RZXZ01000046.1
  ref <309>: DATABASE ENTRY DATE: 2019-04-01
  ref <313>: RELEVANT RESIDUES IN SEQ ID NO: (1)..(1485)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaa

SEQ ID NO: 7659 - DNA, 1462 bp, Rhizobium sp. RSm-3
  ref <308>: DATABASE ACCESSION NUMBER: NCBI ACCESSION: NZ_MAWZ01000043.1
  ref <309>: DATABASE ENTRY DATE: 2019-04-01
  ref <313>: RELEVANT RESIDUES IN SEQ ID NO: (1)..(1462)
tggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacytgcagagatgcarggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7660 - DNA, 1494 bp, Rhizobium sp. RU33A
  ref <308>: DATABASE ACCESSION NUMBER: NCBI ACCESSION: NZ_FTMQ01000018.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgccccgcaaggggagcggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcagtggagacattgtccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaagg

SEQ ID NO: 7661 - DNA, 1496 bp, Rhizobium sp. RU36D
  ref <308>: DATABASE ACCESSION NUMBER: NCBI ACCESSION: NZ_FWXU01000054.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgccccgcaaggggagtggcagacgggtgagtaacgcgtgggaatctacccatccctacggaacaactccgggaaactggagctaataccgtatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagttgactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtttccttcagttcggctggacccaagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7662 - DNA, 1500 bp, Rhizobium sp. Root1203
  ref <308>: DATABASE ACCESSION NUMBER: NCBI ACCESSION: NZ_LMCW01000023.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctaccctttgctacggaataacgcatggaaacgtgtgctaataccgtatgtgtccttcgggagaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7663 - DNA, 1493 bp, Rhizobium sp. Root1204; identical to SEQ ID NO: 7649
  ref <308>: DATABASE ACCESSION NUMBER: NCBI ACCESSION: NZ_LMCZ01000040.1
  ref <309>: DATABASE ENTRY DATE: 2019-04-01
  ref <313>: RELEVANT RESIDUES IN SEQ ID NO: (1)..(1493)

SEQ ID NO: 7664 - DNA, 1493 bp, Rhizobium sp. Root1212
  ref <308>: DATABASE ACCESSION NUMBER: NCBI ACCESSION: NZ_LMDA01000001.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgaacgccccgcaaggggagtggcagacgggtgagtaacgcgtgggaacatacccatcactacggaataactcagggaaacttgtgctaataccgtatacgaccgagaggtgaaagatttatcggtgatggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaacctcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggacagtggagacattgtccttcagttcggctggaccggtgacaggtgctgcatggctgtcgtcagctcgtgtcgtgagatgttgggttaagtcccgcaacgagcgcaaccctcgcccttagttgccagcattaggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7665 - DNA, 1500 bp, Rhizobium sp. Root1220
  ref <308>: DATABASE ACCESSION NUMBER: NCBI ACCESSION: NZ_LMDG01000001.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcatggaaacgtgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctatctacagagatgtagagttcccttcggggaccggagcacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7666 - DNA, 1496 bp, Rhizobium sp. Root1240
  ref <308>: DATABASE ACCESSION NUMBER: NCBI ACCESSION: NZ_LMDR01000001.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgccccgcaaggggagtggcagacgggtgagtaacgcgtgggaatctaccgtaccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtatccttcagttcggctggacccaagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7667 - DNA, 1493 bp, Rhizobium sp. Root1334; identical to SEQ ID NO: 7649
  ref <308>: DATABASE ACCESSION NUMBER: NCBI ACCESSION: NZ_LMEY01000001.1
  ref <309>: DATABASE ENTRY DATE: 2019-04-01
  ref <313>: RELEVANT RESIDUES IN SEQ ID NO: (1)..(1493)

SEQ ID NO: 7668 - DNA, 1500 bp, Rhizobium sp. Root149
  ref <308>: DATABASE ACCESSION NUMBER: NCBI ACCESSION: NZ_LMGD01000021.1
  ref <309>: DATABASE ENTRY DATE: 2019-04-01
  ref <313>: RELEVANT RESIDUES IN SEQ ID NO: (1)..(1500)
ttgaattctcaacttgagagtttgatcctggctcagaacgaacgctggcggcaggcttaacacatgcaagtcgaacgccccgcaaggggagtggcagacgggtgagtaacgcgtgggaacatacccttatcttcggaacaactccgggaaactggagctaataccgaatgtgcccttcgggggaaagatttatcggataaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaacctcggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctcgccacagagatgtggttttcccttcggggaccgggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttctaaggaagc

SEQ ID NO: 7669 - DNA, 1493 bp, Rhizobium sp. Root268; identical to SEQ ID NO: 7664
  ref <308>: DATABASE ACCESSION NUMBER: NCBI ACCESSION: NZ_LMJD01000001.1
  ref <309>: DATABASE ENTRY DATE: 2019-04-01
  ref <313>: RELEVANT RESIDUES IN SEQ ID NO: (1)..(1493)

SEQ ID NO: 7670 - DNA, 1496 bp, Rhizobium sp. Root274; identical to SEQ ID NO: 7666
  ref <308>: DATABASE ACCESSION NUMBER: NCBI ACCESSION: NZ_LMJE01000001.1
  ref <309>: DATABASE ENTRY DATE: 2019-04-01
  ref <313>: RELEVANT RESIDUES IN SEQ ID NO: (1)..(1496)

SEQ ID NO: 7671 - DNA, 1495 bp, Rhizobium sp. Root482
  ref <308>: DATABASE ACCESSION NUMBER: NCBI ACCESSION: NZ_LMFA01000020.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcatccttcggggtgagcggcagacgggtgagtaacgcgtgggaatctacccatctctacggaataacgcatggaaacgtgtgctaataccgtatacgcccttttggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccgcagctcaactgcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggtgacgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7672 - DNA, 1533 bp, Rhizobium sp. Root483D2
  ref <308>: DATABASE ACCESSION NUMBER: NCBI ACCESSION: NZ_LMFB01000027.1
  ref <309>: DATABASE ENTRY DATE: 2019-04-01
  ref <313>: RELEVANT RESIDUES IN SEQ ID NO: (1)..(1533)
ttcaacttgagagtttgatcctggctcagaacgaacgctggcggcaggcttaacacatgcaagtcgagcgcgtagcaatacgagcggcagacgggtgagtaacgcgtgggaatctacccatcactacggaataactcagggaaacttgtgctaataccgtatacgcccctctttaaaaggccaggattattgggttcctggttttttatgggggggaaagatttatcggtgatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccgcagctcaactgcggaactgcctttgatactgtcggtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 7673 - DNA, 1492 bp, Rhizobium sp. Root491; identical to SEQ ID NO: 1180
  ref <308>: DATABASE ACCESSION NUMBER: NCBI ACCESSION: NZ_LMFF01000001.1
  ref <309>: DATABASE ENTRY DATE: 2019-04-01
  ref <313>: RELEVANT RESIDUES IN SEQ ID NO: (1)..(1492)

SEQ ID NO: 7674 - DNA, 1496 bp, Rhizobium sp. Root564
  ref <308>: DATABASE ACCESSION NUMBER: NCBI ACCESSION: NZ_LMGN01000001.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgccccgcaaggggagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaaggaagc

SEQ ID NO: 7675 - DNA, 1492 bp, Rhizobium sp. Root651; identical to SEQ ID NO: 1186
  ref <308>: DATABASE ACCESSION NUMBER: NCBI ACCESSION: NZ_LMHB01000001.1
  ref <309>: DATABASE ENTRY DATE: 2019-04-01
  ref <313>: RELEVANT RESIDUES IN SEQ ID NO: (1)..(1492)

SEQ ID NO: 7676 - DNA, 1500 bp, Rhizobium sp. Root708
  ref <308>: DATABASE ACCESSION NUMBER: NCBI ACCESSION: NZ_LMHV01000001.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataacgcatggaaacgtgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggacagctgcagagatgcagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaaggaagc

SEQ ID NO: 7677 - DNA, 1493 bp, Rhizobium sp. Root73; identical to SEQ ID NO: 7649
  ref <308>: DATABASE ACCESSION NUMBER: NCBI ACCESSION: NZ_LMIF01000029.1
  ref <309>: DATABASE ENTRY DATE: 2019-04-01
  ref <313>: RELEVANT RESIDUES IN SEQ ID NO: (1)..(1493)

SEQ ID NO: 7678 - DNA, 1492 bp, Rhizobium sp. S41; identical to SEQ ID NO: 1185
  ref <308>: DATABASE ACCESSION NUMBER: NCBI ACCESSION: NZ_CP016320.1
  ref <309>: DATABASE ENTRY DATE: 2019-04-01
  ref <313>: RELEVANT RESIDUES IN SEQ ID NO: (1)..(1492)

SEQ ID NO: 7679 - DNA, 1486 bp, Rhizobium sp. SEMIA4064
  ref <308>: DATABASE ACCESSION NUMBER: NCBI ACCESSION: NZ_PYJN01000001.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaatctaccctttactacggaataacgcagggaaacttgtgctaataccgtatgtgtccttcgggagaaagatttatcggtaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccagagagatttggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7680 - DNA, 1485 bp, Rhizobium sp. TAL182; identical to SEQ ID NO: 7581
  ref <308>: DATABASE ACCESSION NUMBER: NCBI ACCESSION: NZ_CP021024.1
  ref <309>: DATABASE ENTRY DATE: 2019-04-01
  ref <313>: RELEVANT RESIDUES IN SEQ ID NO: (1)..(1485)

SEQ ID NO: 7681 - DNA, 1492 bp, Rhizobium sp. TBD182; identical to SEQ ID NO: 1180
  ref <308>: DATABASE ACCESSION NUMBER: NCBI ACCESSION: NZ_BDLN01000028.1
  ref <309>: DATABASE ENTRY DATE: 2019-04-01
  ref <313>: RELEVANT RESIDUES IN SEQ ID NO: (1)..(1492)

SEQ ID NO: 7682 - DNA, 1493 bp, Rhizobium sp. TH135
  ref <308>: DATABASE ACCESSION NUMBER: NCBI ACCESSION: NZ_PKRP01000013.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatccgggtcgcggacagtggagacattgtccttcagttaggctggacccaggacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaag

SEQ ID NO: 7683 - DNA, 1491 bp, Rhizobium sp. UGM030330-04
  ref <308>: DATABASE ACCESSION NUMBER: NCBI ACCESSION: NZ_QKML01000033.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7684 - DNA, 1492 bp, Rhizobium sp. UR51a; identical to SEQ ID NO: 1185
  ref <308>: DATABASE ACCESSION NUMBER: NCBI ACCESSION: NZ_JYFU01000008.1
  ref <309>: DATABASE ENTRY DATE: 2019-04-01
  ref <313>: RELEVANT RESIDUES IN SEQ ID NO: (1)..(1492)

SEQ ID NO: 7685 - DNA, 1486 bp, Rhizobium sp. WW 1
  ref <308>: DATABASE ACCESSION NUMBER: NCBI ACCESSION: NZ_RAIN01000049.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacctctagagatagggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7686 - DNA, 1500 bp, Rhizobium sp. WYCCWR10014; identical to SEQ ID NO: 7571
  ref <308>: DATABASE ACCESSION NUMBER: NCBI ACCESSION: NZ_LXFU01000011.1
  ref <309>: DATABASE ENTRY DATE: 2019-04-01
  ref <313>: RELEVANT RESIDUES IN SEQ ID NO: (1)..(1500)

SEQ ID NO: 7687 - DNA, 1491 bp, Rhizobium sp. Y9; identical to SEQ ID NO: 1192
  ref <308>: DATABASE ACCESSION NUMBER: NCBI ACCESSION: NZ_CP017999.1
  ref <309>: DATABASE ENTRY DATE: 2019-04-01
  ref <313>: RELEVANT RESIDUES IN SEQ ID NO: (1)..(1491)

SEQ ID NO: 7688 - DNA, 1491 bp, Rhizobium sp. YIC5082
  ref <308>: DATABASE ACCESSION NUMBER: NCBI ACCESSION: NZ_POYI01000011.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7689 - DNA, 1415 bp, Rhizobium sp. YK2
  ref <308>: DATABASE ACCESSION NUMBER: NCBI ACCESSION: NZ_LZPI01000028.1
  ref <309>: DATABASE ENTRY DATE: 2019-04-01
  ref <313>: RELEVANT RESIDUES IN SEQ ID NO: (1)..(1415)
ggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgggaccggtgcagagatgcactttccacttcggtggctcagagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7690 - DNA, 1500 bp, Rhizobium sp. YR060; identical to SEQ ID NO: 1194
  ref <308>: DATABASE ACCESSION NUMBER: NCBI ACCESSION: NZ_JQLB01000026.1
  ref <309>: DATABASE ENTRY DATE: 2019-04-01
  ref <313>: RELEVANT RESIDUES IN SEQ ID NO: (1)..(1500)

SEQ ID NO: 7691 - DNA, 1493 bp, Rhizobium sp. YR295; identical to SEQ ID NO: 7628
  ref <308>: DATABASE ACCESSION NUMBER: NCBI ACCESSION: NZ_JQNM01000027.1
  ref <309>: DATABASE ENTRY DATE: 2019-04-01
  ref <313>: RELEVANT RESIDUES IN SEQ ID NO: (1)..(1493)

SEQ ID NO: 7692 - DNA, 1500 bp, Rhizobium sp. YR519
  ref <308>: DATABASE ACCESSION NUMBER: NCBI ACCESSION: NZ_JQLD01000026.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaacgtaccctttactacggaataactcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctacttgcagagatgcaaggttcccttcggggaccggaacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7693 - DNA, 1397 bp, Rhizobium sp. YR528
  ref <308>: DATABASE ACCESSION NUMBER: NCBI ACCESSION: NZ_JUHJ01000028.1
  ref <309>: DATABASE ENTRY DATE: 2019-04-01
  ref <313>: RELEVANT RESIDUES IN SEQ ID NO: (1)..(1397)
gagtaacacgtgggaacgtacccttttctacggaataacccagggaaacttggactaataccgtatgtgcccttcgggggaaagatttatcggaaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgccaagctacctgcagagatgcagggttcccttcggggacttggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7694 - DNA, 1494 bp, Rhizobium sp. YS-1r
  ref <308>: DATABASE ACCESSION NUMBER: NCBI ACCESSION: NZ_JPYQ01000020.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgcgtagcaatacgagcggcagacgggtgagtaacgcgtgggaacatacccttttctacggaataacgcagggaaacttgtgctaataccgtatgagcccttcgggggaaagatttatcgggaaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtgtggaagaggtcagtggaattgcgagtgtagaggtgaaattcgtagatattcgcaggaacaccagtggcgaaggcggctgactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggaccggtccagagatggacttttcccttcggggaccgggacacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgaaggggtgaccccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgctgcgctaaccagcaatggaggcaggcgaccacggtagggtcagcgactggggtgaagtcgtaacaaggtagccgtaggggaacctgcggctggatcacctcctttctaaggaagc

SEQ ID NO: 7695 - DNA, 1491 bp, Rhizobium subbaraonis
  ref <308>: DATABASE ACCESSION NUMBER: NCBI ACCESSION: NZ_OBQD01000060.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccttttgctacggaatagctccgggaaactggaattaataccgtatgtgcccttcgggggaaagatttatcggcaaaagatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcgggtatttaagtcaggggtgaaatcccagagctcaactctggaactgcctttgatactgggtacctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggtttccagagatggattccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgtgctaaccgcaaggaggcagctaaccacggtagggtcagcgactggggtgaagtcgtaacaaggtagccgtaggggaacctgcggctggatcacctcctttctaag

SEQ ID NO: 7696 - DNA, 1500 bp, Rhizobium taibaishanense
  ref <308>: DATABASE ACCESSION NUMBER: NCBI ACCESSION: NZ_MKIN01000011.1
  ref <309>: DATABASE ENTRY DATE: 2019-04-01
  ref <313>: RELEVANT RESIDUES IN SEQ ID NO: (1)..(1500)
ttgaattctcaacttgagagtttgatcctggctcagaacgaacgctggcggcaggcttaacacatgcaagtcgaacgcatcgcaagatgagtggcagacgggtgagtaacgcgtgggaatctaccgtaccctacggaatagctccgggaaactggaattaataccgtatacgcccttcgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggataattaagtcaggggtgaaatcccgcagctcaactgcggaactgcctttgatactggttatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggcaagttgacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcctgtgaccgctacggagacgtagttttcccttcggggacacagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacggcgacgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7697 - DNA, 1487 bp, Rhizobium tropici
  ref <308>: DATABASE ACCESSION NUMBER: NCBI ACCESSION: NZ_QMKK01000016.1
  ref <309>: DATABASE ENTRY DATE: 2019-04-01
  ref <313>: RELEVANT RESIDUES IN SEQ ID NO: (1)..(1487)
tcaacatgagagtttgatcctggctcagaacgaacgctggcggcaggcttaacacatgcaagtcgagcgccccgcaaggggagcggcagacgggtgagtaacgcgtgggaatctaccttttgctacggaataacgcagggaaacttgtgctaataccgtatgtgtccttcgggagaaagatttatcggcaagagatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7698 - DNA, 1481 bp, Rhizobium tubonense
  ref <308>: DATABASE ACCESSION NUMBER: NCBI ACCESSION: NZ_PCDP01000066.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgcctcgcaagaggagcggcagacgggtgagtaacgcgtgggaatctacccatccttacggaacaactccgggaaactggagctaataccgtatacgcccttcgggggaaagatttatcgaggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagccacagagatgtggtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcgcgcgagcgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7699 - DNA, 1481 bp, Rhizobium tumorigenes
  ref <308>: DATABASE ACCESSION NUMBER: NCBI ACCESSION: NZ_PCDQ01000084.1
  ref <309>: DATABASE ENTRY DATE: 2019-04-01
  ref <313>: RELEVANT RESIDUES IN SEQ ID NO: (1)..(1481)
caacatgagagtttgatcctggctcagaacgaacgctggcggcaggcttaacacatgcaagtcgagcgccccgcaaggggagcggcagacgggtgagtaacgcgtgggaatctaccctttgctacggaataacgcatggaaacgtgtgctaataccgtatgtgtccttcgggagaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctatccagagagatttggagttcccttcggggaccgggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgaacgggcgaccgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctccttt

SEQ ID NO: 7700 - DNA, 1493 bp, Rhizobium undicola
  ref <308>: DATABASE ACCESSION NUMBER: NCBI ACCESSION: NZ_JHXQ01000045.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgcatccttcggggtgagcggcagacgggtgagtaacgcgtgggaacgtaccctttcctacggaatagctccgggaaactggaattaataccgtatacgcccttagggggaaagatttatcggggaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggaattactgggcgtaaagcgcacgtaggcgggcatttaagtcaggggtgaaatcccagagctcaactctggaactgcctttgatactgggtgtcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcggcaagttgacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatcctgtgcccgctacggagacgtagttttcccttcggggacacagagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagaatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaaggaag

SEQ ID NO: 7701 - DNA, 1486 bp, Rhizobium vallis
  ref <308>: DATABASE ACCESSION NUMBER: NCBI ACCESSION: NZ_ML133725.1
  ref <309>: DATABASE ENTRY DATE: 2019-04-01
  ref <313>: RELEVANT RESIDUES IN SEQ ID NO: (1)..(1486)
caacatgagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccagagagatttggggtccacttcggtggcgcagagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7702 - DNA, 1132 bp, Rhizobium vignae
  ref <308>: DATABASE ACCESSION NUMBER: NCBI ACCESSION: NZ_JNNU01000047.1
  ref <309>: DATABASE ENTRY DATE: 2019-04-01
  ref <313>: RELEVANT RESIDUES IN SEQ ID NO: (1)..(1132)
gccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcggaagaacaccagtggcgaaggcggcttactggtccattactgacgctgaggtgcgaaagcgtggggagcaaacaggattagataccctggtagtccacgccgtaaacgatgaatgttagccgtcggcaagtttacttgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggccagctacagagatgtagtgttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaggagcgatcccgagctaatctccaaaagccatctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 7703 - DNA, 1491 bp, Rhizobium wuzhouense
  ref <308>: DATABASE ACCESSION NUMBER: NCBI ACCESSION: NZ_QJRY01000021.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtatccttcagttcggctggacccaagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggtgacgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 7704 - DNA, 1469 bp, Rhodobaca barguzinensis
  ref <308>: DATABASE ACCESSION NUMBER: NCBI ACCESSION: NZ_CP024899.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgaacgaagtcttcggacttagtggcggacgggtgagtaacgcgtgggaacgtgccccttggtacggaatagtcccgggaaactgggtttaataccgtatattctctgcggaggaaagatttatcgccaagggatcggcccgcgttggattaggtagttggtggggtaatggcctaccaagcccgcgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcgctggggaagataatgacggtacccagtaaagaagccccggctaactccgtgccagcagccgcggtaatacggagggggctagcgttgttcggaattactgggcgtaaagcgcgcgtaggcggattggaaagttgggggtgaaatcccggggctcaaccccggaactgcctccaaaactatcagtctggagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtggatcgcgggaccagagatggttctttcagttcggctggatccaacacaggtgctgcatggctgtcgtcagctcgtgtcgtgagatgttcggttaagtccggcaacgagcgcaacccacgtccttagttgccagcattcagttgggcactctaaggaaactgccgatgataagtcggaggaaggtgtggatgacgtcaagtcctcatggcccttacgggttgggctacacacgtgctacaatggtagtgacagtgggataatcccaaaaagctatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaaggtggtgcgctaaccagcaatggaggcagccaaccacggtaggctcagcgactggggtgaagtcgtaacaaggtagccgtaggggaacctgcggctggatcacctcctttctaa

SEQ ID NO: 7705 - DNA, 1474 bp, Rhodobacter aestuarii
  ref <308>: DATABASE ACCESSION NUMBER: NCBI ACCESSION: NZ_FTOG01000024.1
  ref <309>: DATABASE ENTRY DATE: 2019-04-01
  ref <313>: RELEVANT RESIDUES IN SEQ ID NO: (1)..(1474)
tcaacttgagagtttgatcctggctcagaacgaacgctggcggcaggcctaacacatgcaagtcgagcgagaccttcgggtctagcggcggacgggtgagtaacgcgtgggaacgtaccctttgctacggaatagccccgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaaccccggaactgcctccaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgagatcgcggatcgtggagacactttccttcagttcggctggatcttagacaggtgctgcatggctgtcgtcagctcgtgtcgtgagatgttcggttaagtccggcaacgagcgcaacccacactcttagttgccagcattcagttgggcactctaggagaactgccgatgataagtcggaggaaggtgtggatgacgtcaagtcctcatggcccttacgggttgggctacacacgtgctacaatggtggtgacaatgggccaatcccaaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgtaaagggggcagctagccacggtaggatcagcgactggggtgaagtcgtaacaaggtagccgtaggggaacctgcggctggatcacctcctttctaagg

SEQ ID NO: 7706 - DNA, 1471 bp, Rhodobacter azotoformans
  ref <308>: DATABASE ACCESSION NUMBER: NCBI ACCESSION: NZ_QAOT01000052.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgagcgaagtcttcggacttagcggcggacgggtgagtaacgcgtgggaacatgcccaaaggtacggaatagccccgggaaactgggagtaataccgtatgtgcccttcgggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggactggaaagtcaggggtgaaatcccggggctcaaccccggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtcctcagttgccagcattcagttgggcactctggggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctttctaa

SEQ ID NO: 7707 - DNA, 1471 bp, Rhodobacter blasticus
  ref <308>: DATABASE ACCESSION NUMBER: NCBI ACCESSION: NZ_CP020470.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaggacttcggtcctagcggcggacgggtgagtaacgcgtgggaacgtgccctttgcttcggaatagccctgggaaactgggagtaataccgaatgtgccctacgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagcgatgaaggccttagggttgtaaagctctttcgtgggggaagataatgactgtaccccaagaagaagccccggctaactccgtgccagcagccgcggtaatacggagggggctagcgttgttcggaattactgggcgtaaagcgcacgtaggcggactggaaagtcaggggtgaaatcccggggctcaaccccggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgggaccagagatggtcctttcagttcggctggataccacacaggtgctgcatggctgtcgtcagctcgtgtcgtgagatgttcggttaagtccggcaacgagcgcaacccacacttccagttgccatcattcagttgggcactctggaggaactgccggtgataagccggaggaaggtgtggatgacgtcaagtcctcatggcccttacgggttgggctacacacgtgctacaatggtggtgacaatgggttaatcccaaaaagccatctcagttcggattgtcgtctgcaactcggcggcatgaagtcggaatcgctagtaatcgcgtaacagcatgacgcggtgaatacgttcccgggccttgtacacaccgcccgtcacaccatgggaattgggtttacccgacgacggtgcgctaacctcgcaagaggaggcagccggccacggtaggctcagtgactggggtgaagtcgtaacaaggtagccgtaggggaacctgcggctggatcacctcctttctaa

SEQ ID NO: 7708 - DNA, 1471 bp, Rhodobacter capsulatus
  ref <308>: DATABASE ACCESSION NUMBER: NCBI ACCESSION: NZ_FNAY01000007.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagaccttcgggtctagcggcggacgggtgagtaacgcgtgggaacgtgccctttgctacggaatagccccgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcaggtgggaagataatgacggtaccaccagaagaagccccggctaactccgtgccagcagccgcggtaatacggagggggctagcgttgttcggaattactgggcgtaaagcgcacgtaggcggatcagaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaggcatgcctgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcccagacaggtgctgcatggctgtcgtcagctcgtgtcgtgagatgttcggttaagtccggcaacgagcgcaacccacactttcagttgccatcattcagttgggcactctggaagaactgccgatgataagtcggaggaaggtgtggatgacgtcaagtcctcatggcccttacgggttgggctacacacgtgctacaatggtggtgacaatgggccaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacccgcaagggaggcagccagccacggtaggctcagtgactggggtgaagtcgtaacaaggtagccgtaggggaacctgcggctggatcacctcctttctaa

SEQ ID NO: 7709 - DNA, 1471 bp, Rhodobacter maris
  ref <308>: DATABASE ACCESSION NUMBER: NCBI ACCESSION: NZ_OBMT01000032.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagaccttcgggtctagcggcggacgggtgagtaacgcgtgggaacgtgccctttgctacggaatagccccgggaaactgggagtaataccgtatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatatttaagtcgggggtgaaatcccggggctcaaccccggaactgccttcgatactggatgtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcccagacaggtgctgcatggctgtcgtcagctcgtgtcgtgagatgttcggttaagtccggcaacgagcgcaacccacactttcagttgccatcattcagttgggcactctggaagaactgccgatgataagtcggaggaaggtgtggatgacgtcaagtcctcatggcccttacgggttgggctacacacgtgctacaatggtggtgacaatgggccaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgtaaagggggcagctagccacggtaggatcagcgactggggtgaagtcgtaacaaggtagccgtaggggaacctgcggctggatcacctcctttctaa

SEQ ID NO: 7710 - DNA, 1471 bp, Rhodobacter ovatus
  ref <308>: DATABASE ACCESSION NUMBER: NCBI ACCESSION: NZ_OAOQ01000035.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgagcgaagtctttggacttagcggcggacgggtgagtaacgcgtgggaacatacccaaaggtacggaatagccctgggaaactgggagtaataccgtatgtgcccttcgggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggattggaaagtcagaggtgaaatcccagggctcaaccttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgggaccagagatggtcctttcagttcggctggataccacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctttctaa

SEQ ID NO: 7711 - DNA, 1471 bp, Rhodobacter sp. AKP1
  ref <308>: DATABASE ACCESSION NUMBER: NCBI ACCESSION: NZ_ANFS01000062.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgagcgaagtcttcggacttagcggcggacgggtgagtaacgcgtgggaacgtgccctttgcttcggaatagccccgggaaactgggagtaataccgaatgtgccctacgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggatcggaaagtcagaggtgaaatcccagggctcaaccctggaactgcctttgaaactcccgatcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctttctaa

SEQ ID NO: 7712 - DNA, 1476 bp, Rhodobacter sp. BO-81
  ref <308>: DATABASE ACCESSION NUMBER: NCBI ACCESSION: NZ_RCHI01000035.1
  ref <309>: DATABASE ENTRY DATE: 2019-04-01
  ref <313>: RELEVANT RESIDUES IN SEQ ID NO: (1)..(1476)
ggtttcaacttgagagtttgatcctggctcagaacgaacgctggcggcaggcctaacacatgcaagtcgagcgagatcttcggatctagcggcggacgggtgagtaacgcgtgggaacgtaccctttgcttcggaatagcctcgggaaactgggagtaataccgaatgtgccctacgggggaaagatttatcggcaaaggatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattattaagtcgggggtgaaatcccggggctcaaccccggaactgccttcgatactggtagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgagatcgcggttaccagagatggtttccttcagttcggctggatcttagacaggtgctgcatggctgtcgtcagctcgtgtcgtgagatgttcggttaagtccggcaacgagcgcaacccacgtcttcagttgccagcattcagttgggcactctgaagaaactgccgatgataagtcggaggaaggtgtggatgacgtcaagtcctcatggcccttacgggttgggctacacacgtgctacaatggcgatgacaatgggccaatcccaaaaagtcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacctgtaaaggaggcagccagccacggtaggctcagtgactggggtgaagtcgtaacaaggtagccgtaggggaacctgcggctggatcacctcctttctaa

SEQ ID NO: 7713 - DNA, 1470 bp, Rhodobacter sp. CCB-MM2
  ref <308>: DATABASE ACCESSION NUMBER: NCBI ACCESSION: NZ_LRRR01000059.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgaagccttcgggcttagcggcggacgggtgagtaacgcgtgggaacgtgccctttgcttcggaatagccccgggaaactgggagtaataccgaatgtgccctacgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagctgggaagataatgacggtaccagcagaagaagccccggctaactccgtgccagcagccgcggtaatacggagggggctagcgttgttcggaattactgggcgtaaagcgcgcgtaggcggactggaaagtcagaggtgaaatcccagggctcaaccttggaactgcctttgaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggtgatcgtagttccgagagatcggttcgtcagttcggctggatcacacacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggtagtgacaatgggataatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggtggtgcgctaacccgcaagggaggcagccaaccacggtaggctcagcgactggggtgaagtcgtaacaaggtagccgtaggggaacctgcggctggatcacctcctttctaa

SEQ ID NO: 7714 - DNA, 1470 bp, Rhodobacter sp. JA431
  ref <308>: DATABASE ACCESSION NUMBER: NCBI ACCESSION: NZ_OBMP01000021.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgagaccttcgggtctagcggcggacgggtgagtaacgcgtgggaacgtaccctttgctacggaatagccccgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaaccccggaactgcctccaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgagatcgcggatcgtggagacactttccttcagttcggctggatcttagacaggtgctgcatggctgtcgtcagctcgtgtcgtgagatgttcggttaagtccggcaacgagcgcaacccacactcttagttgccagcattcagttgggcactctaggagaactgccgatgataagtcggaggaaggtgtggatgacgtcaagtcctcatggcccttacgggttgggctacacacgtgctacaatggtggtgacaatgggccaatcccaaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgtaaagggggcagctagccacggtaggatcagcgactggggtgaagtcgtaacaaggtagccgtaggggaacctgcggctggatcacctcctttcta

SEQ ID NO: 7715 - DNA, 1471 bp, Rhodobacter sp. LPB0142; identical to SEQ ID NO: 6393
  ref <308>: DATABASE ACCESSION NUMBER: NCBI ACCESSION: NZ_CP017781.1
  ref <309>: DATABASE ENTRY DATE: 2019-04-01
  ref <313>: RELEVANT RESIDUES IN SEQ ID NO: (1)..(1471)

SEQ ID NO: 7716 - DNA, 1472 bp, Rhodobacter sp. SW2
  ref <308>: DATABASE ACCESSION NUMBER: NCBI ACCESSION: NZ_ACYY01000039.1
  ref <309>: DATABASE ENTRY DATE: 2019-04-01
  ref <313>: RELEVANT RESIDUES IN SEQ ID NO: (1)..(1472)
tcaacttgagagtttgatcctggctcagaatgaacgctggcggcaggcctaacacatgcaagtcgaacgggtccttcgggactagtggcggacgggtgagtaacgcgtgggaacataccctttggtacggaatagcctcgggaaactgggtgtaataccgtatgtgcccttcgggggaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgatgaaggccttagggttgtaaagctctttcagtggggaagataatgacggtacccacagaagaagccccggctaactccgtgccagcagccgcggtaatacggagggggctagcgttattcggaattactgggcgtaaagcgcacgtaggcggattggaaagttggaggtgaaatcccagggctcaaccttggaactgccttcaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcagtgaccgttccagagatggtcctttctcgtaagagacactgcacacaggtgctgcatggctgtcgtcagctcgtgtcgtgagatgttcggttaagtccggcaacgagcgcaacccacgtctttagttgccagcattcagttgggcactctaaagaaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggtggtgcgccaacctcgcaagaggaggcagccaaccacggtaggatcagtgactggggtgaagtcgtaacaaggtagccgtaggggaacctgcggctggatcacctcctttctaa

SEQ ID NO: 7717 - DNA, 1468 bp, Rhodobacter sp. YIM 73036
  ref <308>: DATABASE ACCESSION NUMBER: NCBI ACCESSION: NZ_QMJY01000060.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgccccgcaaggggagcggcggacgggtgagtaacgcgtgggaacgtgcccctttctacggaatagccctgggaaactgggagtaataccgtataagccctacgggggaaagatttatcgggaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagcgatgaaggccttagggttgtaaagctctttcaggggggaagataatgactgtacccccagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactcccggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcggcctcagagatgaggctttcagttcggctggataccacacaggtgctgcatggctgtcgtcagctcgtgtcgtgagatgttcggttaagtccggcaacgagcgcaacccacactttcagttgccatcattcagttgggcactctggaagaactgccggtgataagccggaggaaggtgtggatgacgtcaagtcctcatggcccttacgggttgggctacacacgtgctacaatggtggtgacaatgggttaatccccaaaagccatctcagttcggattgtcgcctgcaactcggcggcatgaagtcggaatcgctagtaatcgcgtaacagcatgacgcggtgaatacgttcccgggccttgtacacaccgcccgtcacaccatgggaattgggtctacccgacgacggtgcgccaacctcgcgagaggaagcagccggccacggtaggctcagtgactggggtgaagtcgtaacaaggtagccgtaggggaacctgcggctggatcacctcctttcta

SEQ ID NO: 7718 - DNA, 1471 bp, Rhodobacter sphaeroides
  ref <308>: DATABASE ACCESSION NUMBER: NCBI ACCESSION: NZ_CP033435.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgagcgaagtcttcggacttagcggcggacgggtgagtaacgcgtgggaacgtgccctttgcttcggaatagccccgggaaactgggagtaataccgaatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggatcggaaagtcagaggtgaaatcccagggctcaaccctggaactgcctttgaaactcccgatcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctttctaa

SEQ ID NO: 7719 - DNA, 1021 bp, Rhodobacter veldkampii
  ref <308>: DATABASE ACCESSION NUMBER: NCBI ACCESSION: NZ_PZKF01000079.1
  ref <309>: DATABASE ENTRY DATE: 2019-04-01
  ref <313>: RELEVANT RESIDUES IN SEQ ID NO: (1)..(1021)
taactccgtgccagcagccgcggtaatacggagggggctagcgttgttcggaattactgggcgtaaagcgcacgtaggcggattggaaagttgggggtgaaatcccggggctcaacctcggaactgcctccaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggtatcgcggaaccagagatggttctttcagttcggctggataccacacaggtgctgcatggctgtcgtcagctcgtgtcgtgagatgttcggttaagtccggcaacgagcgcaacccacattctcagttgccatcattcagttgggcactctgggaaaactgccggtgataagccggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctcgcaagagggggcagctggccacggtaggctcagcgactggggtgaagtcgtaacaaggtagccgtaggggaacctgcggctggatcacctcctttctaa

SEQ ID NO: 7720 - DNA, 1470 bp, Rhodobacter vinaykumarii
  ref <308>: DATABASE ACCESSION NUMBER: NCBI ACCESSION: NZ_OBMN01000019.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgaggacttcggtcctagcggcggacgggtgagtaacgcgtgggaacgtgccctttgctacggaatagccccgggaaactgggagtaataccgtatgtgcccttcgggggaaagatttatcggcaaaggatcggcccgcgttggattaggtagttggtggggtaacggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaacctcggaactgcctccaaaactcccagtcttgaggtcgagagaggtgagtggaattccgagtgtagaggtgaaattcgtagatattcggaggaacaccagtggcgaaggcggcttactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccggtcgcggttccagagatggatccttcagttcggctggaccggagacaggtgctgcatggctgtcgtcagctcgtgtcgtgagatgttcggttaagtccggcaacgagcgcaacccacacccttagttgccagcattcagttgggcactctaggggaactgccgatgataagtcggaggaaggtgtggatgacgtcaagtcctcatggcccttacgggttgggctacacacgtgctacaatggtggtgacaatgggctaatcccaaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctcgcaagagggggcagctggccacggtaggctcagcgactggggtgaagtcgtaacaaggtagccgtaggggaacctgcggctggatcacctcctttcta

SEQ ID NO: 7721 - DNA, 1471 bp, Rhodobacter viridis
  ref <308>: DATABASE ACCESSION NUMBER: NCBI ACCESSION: NZ_QJTK01000037.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagaccttcgggtctagcggcggacgggtgagtaacgcgtgggaacgtgccctttgctacggaatagccccgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcaggtgggaagataatgacggtaccaccagaagaagccccggctaactccgtgccagcagccgcggtaatacggagggggctagcgttgttcggaattactgggcgtaaagcgcacgtaggcggatcagaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaggcatgcctgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgagatcgcggttaccagagatggtttccttcagttcggctggatcttagacaggtgctgcatggctgtcgtcagctcgtgtcgtgagatgttcggttaagtccggcaacgagcgcaacccacactttcagttgccatcattcagttgggcactctggaagaactgccgatgataagtcggaggaaggtgtggatgacgtcaagtcctcatggcccttacgggttgggctacacacgtgctacaatggtggtgacaatgggccaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacctgcaaaggaggcagccagccacggtaggctcagtgactggggtgaagtcgtaacaaggtagccgtaggggaacctgcggctggatcacctcctttctaa

SEQ ID NO: 7722 - DNA, 1472 bp, Rhodobacteraceae bacterium
  ref <308>: DATABASE ACCESSION NUMBER: NCBI ACCESSION: NZ_SDAL01000007.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgaacgagatcttcggatctagtggcggacgggttagtaacgcgtggggatgtacccaaaggtatggaatagtcccgggaaactgggtttaataccatatgtgcccttagggggaaagatttttcgcctttggatcaacccgcgttggattaggtagttggtggggtaatggcctaccaagccgacgatccatagctggtttgagaggatgatcagcaacactgggactgagacacggcccagactcctacgggaggcagcagtggggaatcttagacaatgggggaaaccctgatctagccatgccgcgtggacgatgaaggccttagggttgtaaagtcctttcagtcgtgaagataatgacggtagcgacagaagaagccccggctaactccgtgccagcagccgcggtaatacggagggggctagcgttgttcggaattactgggcgtaaagcgcacgtaggcggactaataagtcgagggtgaaatcccggggctcaaccccggaactgcctccgatactgttagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctgtcgcggaaacgagagattgtttccttcagttcggctggacaggtgacaggtgctgcatggctgtcgtcagctcgtgtcgtgagatgttcggttaagtccggcaacgagcgcaacccacgtccttagttgccagcagttcggctgggcactctagggaaactgccgatgataagtcggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctcctttctaa

SEQ ID NO: 7723 - DNA, 1469 bp, Rhodobacteraceae bacterium 4F10; identical to SEQ ID NO: 6678
  ref <308>: DATABASE ACCESSION NUMBER: NCBI ACCESSION: NZ_PDUV01000017.1
  ref <309>: DATABASE ENTRY DATE: 2019-04-01
  ref <313>: RELEVANT RESIDUES IN SEQ ID NO: (1)..(1469)

SEQ ID NO: 7724 - DNA, 1470 bp, Rhodobacteraceae bacterium 63075
  ref <308>: DATABASE ACCESSION NUMBER: NCBI ACCESSION: NZ_QVMW01000002.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgaagccttcgggcttagcggcggacgggttagtaacgcgtgggaatgtacccttcactgcgggatagcctctggaaacggagattaataccgcatacgcccttcgggggaaagaatttcggtgagggatcagcccgcgttagattaggtagttggtggggtaatggcctaccaagcctacgatctatagctggttttagaggatgatcagcaacactgggactgagacacggcccagactcctacgggaggcagcagtggggaatcttggacaatgggcgaaagcctgatccagccatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatggagagattcatggttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcaactacaatgggttaatcccaaaaagttgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacctcttcggaggaggcagcggaccacggtaggatcagcgactggggtgaagtcgtaacaaggtagccgtaggggaacctgcggctggatcacctcctttctaa

SEQ ID NO: 7725 - DNA, 1469 bp, Rhodobacteraceae bacterium Alg231-04
  ref <308>: DATABASE ACCESSION NUMBER: NCBI ACCESSION: NZ_FREY01000002.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgtaagattagatagttggtggggtaacggcctaccaagtctacgatctttagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggactagaaagtatggggtgaaatcccagggctcaaccctggaactgcctcataaactcctagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacgtccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7726 - DNA, 425 bp, Rhodobacteraceae bacterium Alg231-30
  ref <308>: DATABASE ACCESSION NUMBER: NCBI ACCESSION: NZ_FREU01000005.1
  ref <309>: DATABASE ENTRY DATE: 2019-04-01
  ref <313>: RELEVANT RESIDUES IN SEQ ID NO: (1)..(425)
tcaacttgagagtttgatcctggctcagaacgaacgctggcggcaggcctaacacatgcaagtcgagcgcactcttcggagtgagcggcggacgggttagtaacgcgtgggaacataccttttggtaaggaatagcctctggaaacggagagtaataccttatacgcccttcgggggaaagatttatcgccgagagattggcccgcgttagattagatagttggtggggtaatggcctaccaagtctacgatctatagctggttttagaggatgatcagcaacactgggactgagacacggcccagactcctacgggaggcagcagtggggaatcttggacamtgggcgcaagcctgatccagccmtgccgcgtgagtgatgaaggccttagggtcgtaaagctctttcgccagcgttgataatg

SEQ ID NO: 7727 - DNA, 1470 bp, Rhodobacteraceae bacterium AsT-22
  ref <308>: DATABASE ACCESSION NUMBER: NCBI ACCESSION: NZ_QLIW01000002.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcttaacacatgcaagtcgagcgagaccttcgggtctagcggcggacgggtgagtaacgcgtgggaacgtgcccttcactacggaatagtcccgggaaactgggtttaataccgtatacgcccttcgggggaaagaatttcggtgaaggatcggcccgcgttagattaggtagttggtggggtaatggcctaccaagcctacgatctatagctggttttagaggatgatcagccacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagttgggggtgaaatcccggggctcaaccccggaactgcctccaaaactcctggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtgtctacagtgggttaatccccaaaagacatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacggccgtgcgctaacctcttcggagggggcagcggaccacggtaggctcagcgactggggtgaagtcgtaacaaggtagccgtaggggaacctgcggctggatcacctcctttctaa

SEQ ID NO: 7728 - DNA, 1465 bp, Rhodobacteraceae bacterium B17
  ref <308>: DATABASE ACCESSION NUMBER: NCBI ACCESSION: NZ_ML119098.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgaaccttcgggttagcggcggacgggtgagtaacgcgtgggaacgtgcccagctctgcgggatagcctctggaaacggagattaataccgcatacgcccttcgggggaaagaatttcggagttggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcgggctattaagtcaggggtgaaatcccggggctcaaccccggaactgcccctgatactggtagccttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagggggcttgccctttggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccgtgaccgctgcagagatgcagtttcccttcggggcacggtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggtgcctacagtgggttaatccccaaaaggcatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaaccttctcgaaggaggcagctggccacggtaggctcagcgactggggtgaagtcgtaacaaggtagccgtaggggaacctgcggctggatcacctcctttctaa

SEQ ID NO: 7729 - DNA, 1477 bp, Rhodobacteraceae bacterium BAR1
  ref <308>: DATABASE ACCESSION NUMBER: NCBI ACCESSION: NZ_CP032125.1
  ref <309>: DATABASE ENTRY DATE: 2019-04-01
  ref <313>: RELEVANT RESIDUES IN SEQ ID NO: (1)..(1477)
caacttgagagtttgatcctggctcagaacgaacgctggcggcaggcctaacacatgcaagtcgagcgcttcccttcggggaggagcggcggacgggttagtaacgcgtgggaatatacccagttctaaggaatagccactggaaacggtgagtaataccttatacgcccttcgggggaaagatttatcggaattggattagcccgcgttagattagatagttggtggggtaacggcctaccaagtcgacgatctatagctggtttgagaggatgatcagcaacactgggactgagacacggcccagactcctacgggaggcagcagtggggaatcttagacaatgggcgcaagcctgatctagccatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcacgtaggcggattggaaagttgggggtgaaatcccagggctcaaccctggaactgcctccaaaactaacagtctagagttcgagagaggtgagtggaattccaagtgtagaggtgaaattcgtagatatttggaggaacaccagtggcgaaggcggctcactggctcgatactgacgctgaggtgcgaaagcgtggggagcaaacaggattagataccctggtagtccacgccgtaaacgatgaatgccagtcgttggatagcatgctattcagtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcggagaccagagatggactctttcagttaggctggacaagatacaggtgctgcatggctgtcgtcagctcgtgtcgtgagatgttcggttaagtccggcaacgagcgcaacccacgtccttagttgccagcaggttaagctgggcactctagggagactgccggtgataagccggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagttggaatcgctagtaatcgcgtaacagcatgacgcggtgaatacgttcccgggccttgtacacaccgcccgtcacaccatgggagttgggtctacccgaaggcagtgcgccaacctcttcggagggggcagctgaccacggtaggttcagcgactggggtgaagtcgtaacaaggtagccgtaggggaacctgcggctggatcacctcctttctaa

SEQ ID NO: 7730 - DNA, 1470 bp, Rhodobacteraceae bacterium BH-SD16
  ref <308>: DATABASE ACCESSION NUMBER: NCBI ACCESSION: NZ_QCYG01000015.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcacgcctaacacatgcaagtcgagcgctaccttcgggtggagcggcggacgggttagtaacgcgtgggaacatacccttttctgaggaataaccattggaaacgatgactaatacctcatacgcccttcgggggaaagatttatcggtgaaggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgtgtgacgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcgcgtaggcgggctggcaagtatggggtgaaatcccggggctcaaccccggaactgccctgtaaactgtcagcctagagttcgagagaggtgagtggaattccgagtgtagaggtgaaattcgtagatattcggaggaacaccagtggcgaaggcgactcactggctcgatactgacgctgaggtgcgaaagcgtggggagcaaacaggattagataccctggtagtccacgccgtaaacgatgaatgccagtcgtcagggggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatggagagatctatggttcccttcggggacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcatctacaacgggttaatcccgaaaagatgtctcagttcggattggggtctgcaactcgaccccatgaagtcggaatcgctagtaatcgcggaacagcatgccgcggtgaatacgttcccgggccttgtacacaccgcccgtcacaccatgggagttggttctacccgacggccgtgcgctaacccttacgggaggcagcggaccacggtaggatcagcgactggggtgaagtcgtaacaaggtagccctaggggaacctggggctggatcacctcctttctaa

SEQ ID NO: 7731 - DNA, 1473 bp, Rhodobacteraceae bacterium CCMM004
  ref <308>: DATABASE ACCESSION NUMBER: NCBI ACCESSION: NZ_RZWH01000004.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgctctcttcggagggagcggcgaacgggtgagtaacgcgtgggaatatacccttctctgcggaatagcctctggaaacggagagtaataccgcatacgcccttcgggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgacgaaggccctagggtcgtaaagctctttcgccagggaagataatgactgtacctggtaaagaagtcccggctaactccgtgccagcagccgcggtaatacggaggggactagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatctggatcgtagttccgagagatcggttcgtcagttaggctggatccaagacaggtgctgcatggctgtcgtcagctcgtgtcgtgagatgttcggttaagtccggcaacgagcgcaacccacacccttagttaccagcggttcggccggggactctaagggaactgcctgtgataagcaggaggaaggtgtggatgacgtcaagtcctcatggcccttacgggttgggctacacacgtgctacaatggtggtgacaatgggttaatctccaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctgttcgcaggaggcagctggccacggtaggctcagcgactggggtgaagtcgtaacaaggtagccgtaggggaacctgcggctggatcacctcctttctaa

SEQ ID NO: 7732 - DNA, 1545 bp, Rhodobacteraceae bacterium CH30
  ref <308>: DATABASE ACCESSION NUMBER: NCBI ACCESSION: NZ_RQSQ01000042.1
  ref <309>: DATABASE ENTRY DATE: 2019-04-01
  ref <313>: RELEVANT RESIDUES IN SEQ ID NO: (1)..(1545)
agattgaactgaagagtttgatcctggctcagattgaacgctggcggcatgctttacacatgcaagtcgaacggtaacaggggcttcggcctgctgacgagtggcgaacgggtgagtaatgcgtcggaacgtgccaagtagtgggggataacgcatcgaaaggtgtgctaataccgcatacgctctgaggaggaaagcaggggatcttaggaccttgcgctatttgagcggccgacgtctgattagctagttggtggggtaaaggcctaccaaggcgacgatcagtagctggtctgagaggatgatcagccacactggaactgagacacggtccagactcctacgggaggcagcagtggggaattttggacaatgggcgcaagcctgatccagccatgccgcgtgagtgaagaaggccttcgggttgtaaagctcttttgtccgggaggaaatccctgaagttaataccttcaggggatgacagtactggaagaataagcaccggctaactacgtgccagcagccgcggtaatacgtagggtgcaagcgttaatcggaattactgggcgtaaagcgtgcgcaggcggtttgataagtaagatgtgaaatccccgggcttaacctgggaactgcgttttaaactgtcagactagagtacgtcagaggggggtagaattccacgtgtagcagtgaaatgcgtagagatgtggaggaataccgatggcgaaggcagccccctgggatgatactgacgctcatgcacgaaagcgtggggagcaaacaggattagataccctggtagtccacgccctaaacgatgtcaattagctgttgggggttagaatccttggtagcgtagctaacgcgtgaaattgaccgcctggggagtacggccgcaaggttaaaactcaaaggaattgacgggggcccgcacaagcggtggatgatgtggattaattcgatgcaacgcgaaaaaccttacctacccttgacatgtatcgaacttgccagagatggcttggtgcccgaaagggagcgataacacaggtgctgcatggctgtcgtcagctcgtgtcgtgagatgttgggttaagtcccgcaacgagcgcaacccttgccattagttgccatcattaagttgggcactctaatgggactgccggtgacaaaccggaggaaggtggggatgacgtcaagtcctcatggcccttatgggtagggcttcacacgtcatacaatggtcggtacagagggttgcgaagccgcgaggtggagctaatctcataaaaccgatcgtagtccggatcgcactctgcaactcgagtgcgtgaagtcggaatcgctagtaatcgcggatcagcatgccgcggtgaatacgttcccgggccttgtacacaccgcccgtcacaccatgggagtgggtttcaccagaagtgggtaggctaaccgtaaggaggccgcttaccacggtgggattcatgactggggtgaagtcgtaacaaggtagccgtaggggaacctgcggctggatcacctcctttctag

SEQ ID NO: 7733 - DNA, 1469 bp, Rhodobacteraceae bacterium DSL-40
  ref <308>: DATABASE ACCESSION NUMBER: NCBI ACCESSION: NZ_QKPN01000044.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgcacccttcggggtgagcggcggacgggtgagtaacgcgtgggaacgtgcccttttcttcggaatagcctcgggaaactgagattaatgccggatacgcccttttggggaaagatttatcggagaaggatcggcccgcgtctgattaggtagttggtggggtaatggcctaccaagccgacgatcagtagctggtttgagaggatgatcagccacactgggactgagacacggcccagactcctacgggaggcagcagtggggaatcttggacaatgggggcaaccctgatccagccatgccgcgtgaacgatgaaggccttagggttgtaaagttctttcagcgaggaagataatgacggtactcgcagaagaagccccggctaactccgtgccagcagccgcggtaatacggagggggctagcgttgttcggaattactgggcgtaaagcgcacgtaggcggatcagtcagttaggggtgaaatcccagggctcaaccctggaactgcctttaatactgctggtctggaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgagagctagtcgtcagggggcatgccctttggtgacgcagttaacgcattaagctctccgcctggggagtacggccgcaaggttaaaactcaaaggaattgacgggggcccgcacaagcggtggagcatgtggtttaattcgaagcaacgcgcagaaccttaccatcccttgacttggacgtcgcgggcccagagatgggtctttcagttcggctggacgtcacacaggtgctgcatggctgtcgtcagctcgtgtcgtgagatgttgggttaagtcccgcaacgagcgcaaccctcgctgctagttgccagcattaagttgggcactctagtggaaccgccggtgataagccggaggaaggtggggatgacgtcaagtcctcatggcccttacgggatgggctacacacgtgctacaatggcagtgacaatgggctaatccccaaaagctgtctcagttcggattggggtctgcaactcgaccccatgaagttggaatcgctagtaatcgcgtaacagcatgacgcggtgaatacgttcccgggccttgtacacaccgcccgtcacaccatgggaattgggtctacccgaaggtggtgcgccaaccagcaatggaggcagccaaccacggtcggctcagtgactggggtgaagtcgtaacaaggtagccgtaggggaacctgcggctggatcacctcctttctaa

SEQ ID NO: 7734 - DNA, 1470 bp, Rhodobacteraceae bacterium EL129
  ref <308>: DATABASE ACCESSION NUMBER: NCBI ACCESSION: NZ_ONZJ01000002.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcacgcctaacacatgcaagtcgagcgcaccttcgggtgagcggcggacgggttagtaacgcgtgggaacatacccttctctaaggaatagccactggaaacggtgagtaataccttatacgcccttcgggggaaagatttatcggagatggattggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagcgatgccgcgtgtgtgatgaaggtcttaggatcgtaaagcactttcaccagggatgataatgacagtacctggaaaagaaaccccggctaactccgtgccagcagccgcggtaatacggagggggttagcgttgttcggaattactgggcgtaaagcgtacgtaggcggatcagaaagtatggggtgaaatcccagggctcaaccctggaactgcctcataaactcctggtcttgagttcgagagaggtgagtggaactccgagtgtagaggtgaaattcgtagatattcggaagaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttagacgagagtctttccttcagttcggctggatcagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttatagggggcagcggaccacggtgagctcagcgactggggtgaagtcgtaacaaggtagccgtaggggaacctgcggctggatcacctcctttctaa

SEQ ID NO: 7735 - DNA, 667 bp, Rhodobacteraceae bacterium EL53
  ref <308>: DATABASE ACCESSION NUMBER: NCBI ACCESSION: NZ_OMPR01000010.1
  ref <309>: DATABASE ENTRY DATE: 2019-04-01
  ref <313>: RELEVANT RESIDUES IN SEQ ID NO: (1)..(667)
tcaacttgagagtttgatcctggctcagaacgaacgctggcggcaggcctaacacatgcaagtcgagcgcactcttcggagtgagcggcggacgggttagtaacgcgtgggaatatgcccttctctaaggaatagccactggaaacggtgagtaataccttatacgcccttcgggggaaagatttatcggagaaggattagcccgcgtaagattagatagttggtggggtaatggcctaccaagtctacgatctttagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtaaggggtgaaatcccagagctcaaccctggaactgcctcttaaactcctggtcttgagttcgagagaggtgagtggaattccgagtgtagaggtgaaattcgtagatattcggaggaacaccagt

SEQ ID NO: 7736 - DNA, 1472 bp, Rhodobacteraceae bacterium EhC02
  ref <308>: DATABASE ACCESSION NUMBER: NCBI ACCESSION: NZ_LXYH01000018.1
  ref <309>: DATABASE ENTRY DATE: 2019-04-01
  ref <313>: RELEVANT RESIDUES IN SEQ ID NO: (1)..(1472)
tcaacttgagagtttgatcctggctcagaacgaacgctggcggcaggcctaacacatgcaagtcgagcggcaccttcgggtgtagcggcggacgggttagtaacgcgtgggaacgtgcccttctctacggaatagcctcgggaaactgagagtaataccgtatacgcccttcgggggaaagatttatcggagaaggatcggcccgcgtctgattagatagttggtggggtaatggcctaccaagtctacgatcagtagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccagggctcaaccctggaacggcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccggagagattcggttttctcgtaagagacctagtgacaggtgctgcatggctgtcgtcagctcgtgtcgtgagatgttcggttaagtccggcaacgagcgcaacccacatccctagttgccagcaggtcaagctgggcactctatggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctcttcggagggggcagcggaccacggtgagctcagcgactggggtgaagtcgtaacaaggtagccgtaggggaacctgcggctggatcacctcctttctaa

SEQ ID NO: 7737 - DNA, 1470 bp, Rhodobacteraceae bacterium FSX-11
  ref <308>: DATABASE ACCESSION NUMBER: NCBI ACCESSION: NZ_KZ826499.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgcagtccttcgggaccgagcggcggacgggttagtaacgcgtgggaacgtacccttttctacggaatagcctcgggaaactgagagtaataccgtataagcccttcgggggaaagatttatcgggaaaggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactagtcagtcagaggtgaaatcccagggctcaaccctggaactgcctttgatactgctagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacacagagagatctgtggttcccttcggggacgcagtgacaggtgctgcatggctgtcgtcagctcgtgtcgtgagatgttcggttaagtccggcaacgagcgcaacccacatccctagttgccagcaagttatgttgggcactctatggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacatcatgggagttggttctacccgacgacgctgcgctaaccttcgggaggcaggcggccacggtaggatcagcgactgggatgaagtcgtaacaaggtagccgtaggggaacctgcggctggatcacctcctttctaa

SEQ ID NO: 7738 - DNA, 1465 bp, Rhodobacteraceae bacterium HIMB11
  ref <308>: DATABASE ACCESSION NUMBER: NCBI ACCESSION: NZ_AVDB01000023.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacgtgcccttctctacggaatagcctctggaaacggagagtaataccgtatacgccctttgggggaaagatttatcggagaaggatcggcccgcgttagattaggtagttggtggggtaacggcctaccaagcctacgatctatagctggttttagaggatgatcagcaacactgggactgagacacggcccagactcctacgggaggcagcagtggggaatcttagacaatgggggcaaccctgatctagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggattagaaagttgggggtgaaatcccggggctcaacctcggaactgcctccaaaactactagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtagtgacaatgggttaatcccaaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 7739 - DNA, 1471 bp, Rhodobacteraceae bacterium HTCC2083
  ref <308>: DATABASE ACCESSION NUMBER: NCBI ACCESSION: NZ_DS995276.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcagtccttcgggaccgagcggcggacgggttagtaacgcgtgggaatatgcccttcactacggaatagcctcgggaaactgagagtaataccgtatacgcccttcgggggaaagatttatcggtgaaggattagcccgcgtaagattagatagttggtggggtaatggcctaccaagtctacgatctttagctggttttagaggatgatcagcaacactgggactgagacacggcccagactcctacgggaggcagcagtggggaatcttggacaatgggcgcaagcctgatccagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagctaggctggacgagatacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 7740 - DNA, 1470 bp, Rhodobacteraceae bacterium HTCC2150
  ref <308>: DATABASE ACCESSION NUMBER: NCBI ACCESSION: NZ_AAXZ01000008.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaatacatgcaagtcgagcgccctcttcggagggagcggcggacgggttagtaacgcgtgggaatatgcccttctctacggaatagcctcgggaaactgagattaataccgtatacgcccttcgggggaaagatttatcggagaaggattagcccgcgtaagattagatagttggtggggtaacggcctaccaagtcgacgatctttagctggtttgagaggatgatcagcaacactgggactgagacacggcccagactcctacgggaggcagcagtagggaatcttagacaatgggcgcaagcctgatctagccatgccgcgtgagtgaagaaggccctagggtcgtaaaactctttcgccagagatgataatgacagtatctggtaaagaaaccccggctaactccgtgccagcagccgcggtaatacggagggggttagcgttgttcggaattactgggcgtaaagcgtacgtaggcggattagtaagttaggggtgaaatcccagggctcaaccctggaactgcctctaaaactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagcaagtatacttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccggagacggtttccttcatttagttggatcagtgacaggtgctgcatggctgtcgtcagctcgtgtcgtgagatgttcggttaagtccggcaacgagcgcaacccacatctttagttgccagcaggttaagctgggcactctagagaaactgcccgtgataagcgggaggaaggtgtggatgacgtcaagtcctcatggcccttacgggttgggctacacacgtgctacaatggcatttacaatgggttaatccccaaaagatgtctcagttcggattggggtctgcaactcgaccccatgaagttggaatcgctagtaatcgtagaacagcatgctacggtgaatacgttcccgggccttgtacacaccgcccgtcacaccatgggagttggttctacctgacgacgctgcgctaaccttcgggaggcaagcggccacggtgggatcagcgactggggtgaagtcgtaacaaggtagccctaggggaacctggggctggatcacctcctttctaa

SEQ ID NO: 7741 - DNA, 1467 bp, Rhodobacteraceae bacterium KLH11
  ref <308>: DATABASE ACCESSION NUMBER: NCBI ACCESSION: NZ_DS999531.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcctttcggggcgagcggcggacgggttagtaacgcgtgggaatataccctttggtacggaatagcctctggaaacggagagtaataccgtatgagcccttcgggggaaagatttatcgccaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagttgggggtgaaatcccggggctcaaccccggaactgcctccaaaactatcagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccggtccagagatgggcctttcacttcggtgactcggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttgggggcagcggaccacggtaggatcagcgactggggtgaagtcgtaacaaggtagccgtaggggaacctgcggctggatcacctcctttctaa

SEQ ID NO: 7742 - DNA, 1531 bp, Rhodobacteraceae bacterium LMIT002
  ref <308>: DATABASE ACCESSION NUMBER: NCBI ACCESSION: NZ_QDFI01000130.1
  ref <309>: DATABASE ENTRY DATE: 2019-04-01
  ref <313>: RELEVANT RESIDUES IN SEQ ID NO: (1)..(1531)
caacttgagagtttgatcctggctcagaacgaacgctggcggcaggcctaacacatgcaagtcgagcgaggacttcggtcctagcggcggacgggttagtaacgcgtgggaacgtgcccttctctacggaatagtcccgggaaactgggtttaataccgtatacgccccctcaatcaaatgtcacatttgattggtttatccgatcataccaaatgcctgtggcatttgatgggggggaaagatttatcggagaaggatcggcccgcgttggattaggtagttggtggggtaatggcctaccaagcctacgatccatagctggtttgagaggatgatcagcaacactgggactgagacacggcccagactcctacgggaggcagcagtggggaatcttcggcaatgggcgcaagcctgaccgagccatgccgcgtgagcgatgaaggccttagggttgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagttgggggtgaaatcccggggctcaaccccggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtggatcgcggggccagagatggctctttcagttcggctggatccagcacaggtgctgcatggctgtcgtcagctcgtgtcgtgagatgttcggttaagtccggcaacgagcgcaacccacacccctggttgccagcaggtcaagctgggcactttaggggaactgcccgtgataagcgggaggaaggtgtggatgacgtcaagtcctcatggcccttacgggttgggctacacacgtgctacaatggcagtgacaatgggttaatcccaaaaagctgtctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacctgacggccgtgcgctaaccttcggggggcagcggaccacggtaggatcagcgactggggtgaagtcgtaacaaggtagccgtaggggaacctgcggctggatcacctcctttctaa

SEQ ID NO: 7743 - DNA, 1469 bp, Rhodobacteraceae bacterium Lw-13e
  ref <308>: DATABASE ACCESSION NUMBER: NCBI ACCESSION: NZ_QBBT01000014.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcatccttcggggtgagcggcggacgggtgagtaacgcgtgggaatatgcccttctctacggaatagcctcgggaaactgagagtaataccgtatacgcccttcgggggaaagatttatcggagaaggattagcccgcgttggattagatagttggtggggtaatggcctaccaagtcgacgatccatagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcgggggtgaaatcccggggctcaaccccggaactgccctcgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacatcatgggagttgggtttacccgaagacggtgcgccaacctttcgagggggcagctggccacggtaggctcagcgactgggatgaagtcgtaacaaggtagccgtaggggaacctgcggctggatcacctcctttctaa

SEQ ID NO: 7744 - DNA, 1474 bp, Rhodobacteraceae bacterium MA-7-27
  ref <308>: DATABASE ACCESSION NUMBER: NCBI ACCESSION: NZ_RCNT01000003.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgctctcttcggagggagcggcggacgggttagtaacgcgtgggaatatgcccttctctacggaatagcctcgggaaactgagagtaataccgtatacgcccttcgggggaaagatttatcggagaaggattagcccgcgttggattaggtagttggtggggtaatggcctaccaagccgacgatccatagctggtttgagaggatgatcagcaacactgggactgagacacggcccagactcctacgggaggcagcagtggggaatcttagacaatgggggaaaccctgatctagccatgccgcgtgagtgacgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcaggaggcttgcctcttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccggagacggtttccttcagttcggctggatcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaaggtggtgcgccaacctgttcgcaggaggcagccaaccacggtaggatcagcgactggggtgaagtcgtaacaaggtagccgtaggggaacctgcggctggatcacctcctttctaa

SEQ ID NO: 7745 - DNA, 1469 bp, Rhodobacteraceae bacterium O448
  ref <308>: DATABASE ACCESSION NUMBER: NCBI ACCESSION: NZ_QGNX01000032.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgatcccttcggggatagcggcggacgggtgagtaacgcgtgggaacgtgcccttctctacggaatagcccagggaaacttggattaataccgtatacgcccttcgggggaaagatttatcggagaaggatcggcccgcgttagattaggtagttggtggggtaatggcctaccaagccgacgatctatagctggtttgagaggatgatcagccacactgggactgagacacggcccagactcctacgggaggcagcagtggggaatcttagacaatgggggcaaccctgatctagccatgccgcgtgtgtgatgaaggccttagggtcgtaaagcactttcgccagggaagataatgacggtacctggtaaagaaaccccggctaactccgtgccagcagccgcggtaatacggagggggttagcgttgttcggaattactgggcgtaaagcgcgcgtaggcggatcagcaagttaggggtgaaatcccggggctcaaccccggaactgcccttaaaactgctgacctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcgcagttaacgcattaagcattccgcctggggagtacggtcgcaagattaaaactcaaaggaattgacgggggcccgcacaagcggtggagcatgtggtttaattcgaagcaacgcgcagaaccttaccatcccttgacatcctgatcgcggttttccgagaggaattccttcagttcggctggatcagtgacaggtgctgcatggctgtcgtcagctcgtgtcgtgagatgttgggttaagtcccgcaacgagcgcaaccctcgcctttagttgccagcattcagttgggcactctagaggaaccgccggtgataagccggaggaaggtggggatgacgtcaagtcctcatggcccttacgggatgggctacacacgtgctacaatggtatctacagtgggttaatccccaaaagatatctcagttcggattggggtctgcaactcgaccccatgaagttggaatcgctagtaatcgcgtaacagcatgacgcggtgaatacgttcccgggccttgtacacaccgcccgtcacaccatgggaattggatctacccgaaggtggtgcgccaaccgcaaggaggcagccaaccacggtaggttcagtgactggggtgaagtcgtaacaaggtagccgtaggggaacctgcggctggatcacctcctttctaa

SEQ ID NO: 7746 - DNA, 1467 bp, Rhodobacteraceae bacterium PD-2
  ref <308>: DATABASE ACCESSION NUMBER: NCBI ACCESSION: NZ_KN714899.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgctctcttcggagggagcggcggacgggtgagtaacacgtgggaatatgcccttctctgcggaatagcctcgggaaactgagagtaataccgcatacgcccttcgggggaaagatttatcggagaaggattagcccgcgttagattaggtagttggtggggtaatggcctaccaagcctacgatctatagctggttttagaggatgatcagccacactgggactgagacacggcccagactcctacgggaggcagcagtgaggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatcgagagatcgatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtatctacaatgggttaatccccaaaagatatctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 7747 - DNA, 1468 bp, Rhodobacteraceae bacterium Pet-1
  ref <308>: DATABASE ACCESSION NUMBER: NCBI ACCESSION: NZ_RRYH01000064.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgaggacttcggtcctagcggcggacgggtgagtaacgcgtgggaacgtgcccttctctacggaatagtcccgggaaactgggtttaataccgtatacgccctttgggggaaagatttatcggagaaggatcggcccgcgttggattaggtagttggtggggtaacggcctaccaagccgacgatccatagctggtttgagaggatgatcagccacactgggactgagacacggcccagactcctacgggaggcagcagtggggaatcttggacaatgggggaaaccctgatccagccatgccgcgtgagcgatgaaggccttagggttgtaaagctctttcagtggggaagataatgacggtacccacagaagaagccccggctaactccgtgccagcagccgcggtaatacggagggggctagcgttgttcggaattactgggcgtaaagcgcacgtaggcgggctatcaagttgggggtgaaatcccggggctcaaccccggaactgcctccaaaactggtagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggcgtcgcggatcgggagaccgatctttcagttcggctggacgccacacaggtgctgcatggctgtcgtcagctcgtgtcgtgagatgttcggttaagtccggcaacgagcgcaacccacgcctttagttgccatctttcagtagggcactctaaaggaactgccgatgataagtcggaggaaggtgtggatgacgtcaagtcctcatggcccttacgggttgggctacacacgtgctacaatggcggtgacaatgggctaacccccaaaagccgtctcagttcggatcggggtctgcaactcgaccccgtgaagtcggaatcgctagtaatcgcgtaacagcatgacgcggtgaatacgttcccgggccttgtacacaccgcccgtcacaccatgggagttgggtctacccgaaggtggtgcgccaaccagcaatggaggcagccaaccacggtaggctcagcgactggggtgaagtcgtaacaaggtagccgtaggggaacctgcggctggatcacctcctttcta

SEQ ID NO: 7748 - DNA, 1467 bp, Rhodobacteraceae bacterium SB2
  ref <308>: DATABASE ACCESSION NUMBER: NCBI ACCESSION: NZ_LGRT01000017.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggttagtaacgcgtgggaacgtacccttttctacggaatagcctttggaaacgaagagtaataccgtatacgccctttgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattggaaagttgggggtgaaatcccggggctcaaccccggaactgcctccaaaactatcagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagttcggctggacgagatacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccctaggggaacctggggctggatcacctcctttctaa

SEQ ID NO: 7749 - DNA, 1471 bp, Rhodobacteraceae bacterium SM1703
  ref <308>: DATABASE ACCESSION NUMBER: NCBI ACCESSION: NZ_QZEX01000026.1
  ref <309>: DATABASE ENTRY DATE: 2019-04-01
  ref <313>: RELEVANT RESIDUES IN SEQ ID NO: (1)..(1471)
gtttaaacttgagagtttgatcctggctcagaacgaacgctggcggcaggcctaacacatgcaagtcgagcgctctcttcggagggagcggcggacgggtgagtaacgcgtgggaacgtacccagatctgcggaatagccactggaaacggtgagtaataccgcatacgcccttcgggggaaagatttatcggatttggatcggcccgcgttagattaggtagttggtggggtaatggcctaccaagcctacgatctatagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgcctgtgaagataatgacggtagcaggtaaagaagtcccggctaactccgtgccagcagccgcggtaatacggaggggactagcgttgttcggaattactgggcgtaaagcgcgcgtaggcggactagtcagtcagaggtgaaatcccagggctcaaccctggaactgcctttgatactgctagtcttgagttcgagagaggtgagtggaattccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgtgctacatggagagatccatggttcccttcggggacgcggtgacaggtgctgcatggctgtcgtcagctcgtgtcgtgagatgttcggttaagtccggcaacgagcgcaacccacatccttagttgccagcattcagttgggcactctagggggactgcccgtgttaagcgggaggaaggtgtggatgacgtcaagtcctcatggcccttacgggttgggctacacacgtgctacaatggtggtgacaatgggttaatcctaaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaaccagcaatggaggcagccgaccacggtaagctcagcgactggggtgaagtcgtaacaaggtagccgtaggggaacctgcggctggatcacctcctttctaa

SEQ ID NO: 7750 - DNA, 1468 bp, Rhodobacteraceae bacterium TG-679
  ref <308>: DATABASE ACCESSION NUMBER: NCBI ACCESSION: NZ_QGKU01000029.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgaacgagatcttcggatctagtggcggacgggttagtaacgcgtgggaacgtgcccttctctacggaatagtcccgggaaactgggtttaataccgtatacgcccttcgggggaaagaatttcggggaaggatcggcccgcgttggattaggtagttggtggggtaatggcctaccaagcctacgatccatagctggtttgagaggatgatcagcaacactgggactgagacacggcccagactcctacgggaggcagcagtggggaatcttcggcaatgggcgcaagcctgaccgagccatgccgcgtgagcgatgaaggccttagggttgtaaagctctttcgccagggatgataatgacagtacctggtaaagaaaccccggctaactccgtgccagcagccgcggtaatacggagggggttagcgttgttcggaattactgggcgtaaagcgcacgtaggcggattggaaagttgggggtgaaatcccggggctcaaccccggaactgcctccaaaactatcagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatctggatcgcggttttccgagaggaattccttcagttcggctggatccaagacaggtgctgcatggctgtcgtcagctcgtgtcgtgagatgttcggttaagtccggcaacgagcgcaacccacgcctttagttgccagcagttcggctgggcactctaaaggaactgccgatgataagtcggaggaaggtgtggatgacgtcaagtcctcatggcccttacgggttgggctacacacgtgctacaatggcagtgacaatgggttaatcccaaaaagctgtctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacctgacgacgctgcgctaaccttcggggggcaggcggccacggtaggatcagcgactggggtgaagtcgtaacaaggtagccgtaggggaacctgcggctggatcacctcctttcta

SEQ ID NO: 7751 - DNA, 1466 bp, Rhodobacteraceae bacterium THAF1
  ref <308>: DATABASE ACCESSION NUMBER: NCBI ACCESSION: NZ_UXAS01000009.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcctaacacatgcaagtcgagcgcaccttcgggtgagcggcggacgggtgagtaacgcgtgggaacgtaccctttactgcggaatagcctcgggaaactgagagtaataccgcatacgcccttcgggggaaagatttatcggtaaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgacgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggttatcgtagtttccagagatggatccgtcagttcggctggataacacacaggtgctgcatggctgtcgtcagctcgtgtcgtgagatgttcggttaagtccggcaacgagcgcaacccacatccttagttgccatcattcagttgggcactctagggaaactgcccgtgataagcgggaggaaggtgtggatgacgtcaagtcctcatggcccttacgggttgggctacacacgtgctacaatggtgcctacagtgggttaatccccaaaaggcatctcagttcggattgtcgtctgcaactcgacggcatgaagtcggaatcgctagtaatcgtggaacagcatgccacggtgaatacgttcccgggccttgtacacaccgcccgtcacaccatgggagttggttctacctgacgacgctgcgctaaccttcggggggcaggcggccacggtaggatcagcgactggggtgaagtcgtaacaaggtagccgtaggggaacctgcggctggatcacctcctttctaa

SEQ ID NO: 7752 - DNA, 1473 bp, Rhodobacteraceae bacterium W635
  ref <308>: DATABASE ACCESSION NUMBER: NCBI ACCESSION: NZ_QVQC01000084.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgaagccttcgggcttagcggcggacgggtgagtaacgcgtgggaacgtgccctttcctgcgggatagcctctggaaacggagattaataccgcatacgcccttcgggggaaagatttatcggggaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggtcttaggatcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggatcagtcagtcaggggtgaaatcccggggctcaaccccggaacggcccttgatactgctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatctggatcgcggttttccgagaggaattccttcagttcggctggatccaagacaggtgctgcatggctgtcgtcagctcgtgtcgtgagatgttcggttaagtccggcaacgagcgcaacccacatctttagttgccagcagttcggctgggcactctagggaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgtggaacagcatgccacggtgaatacgttcccgggccttgtacacaccgcccgtcacaccatgggagttgggtccacccgaaggccgtgcgccaacctcttcggaggaggcagcggaccacggtgagctcagcgactggggtgaagtcgtaacaaggtagccctaggggaacctggggctggatcacctcctttcta

SEQ ID NO: 7753 - DNA, 1472 bp, Rhodobacteraceae bacterium WD3A24
  ref <308>: DATABASE ACCESSION NUMBER: NCBI ACCESSION: NZ_PUHN01000091.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgatcccttcggggatagcggcggacgggtgagtaacgcgtgggaacgtgcccttcactgcggactagtccctggaaacggggtttaatgccgcatacgcccttcgggggaaagatttatcggtgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccctagggttgtaaagctctttcgcctgggaagataatgacggtaccaggtaaagaagccccggctaactccgtgccagcagccgcggtaatacggagggggctagcgttgttcggaattactgggcgtaaagcgcgcgtaggcgggctggaaagttgggggtgaaatcccggggctcaaccccggaactgccttcaaaactaccagtctggagttcgagagaggtgagcggaattgcgagtgtagaggtgaaattcgtagatattcgcaggaacaccagtggcgaaggcggctcactggctcgatactgacgctgaggcgcgaaagcgtggggagcaaacaggattagataccctggtagtccacgccgtaaacgatgaatgccagacgtcgggcagcatgctgttcggtgtcgcacttaacggattaagcattccgcctggggagtacggccgcaaggttaaaactcaaaggaattgacgggggcccgcacaagcggtggagcatgtggtttaattcgaagcaacgcgcagaaccttaccaacccttgacatccctgtcgcggtttccggagacggaatccttcagttcggctgggcaggtgacaggtgctgcatggctgtcgtcagctcgtgtcgtgagatgttcggttaagtccggcaacgagcgcaacccacgtcctcagttgccagcattgagttgggcactctggggaaactgccgatgataagtcggaggaaggtgtggatgacgtcaagtcctcatggcccttacgggttgggctacacacgtgctacaatggcggtgacagagggataatcccgaaaaaccgtctcagttcggattggggtctgcaactcgaccccatgaagtcggaatcgctagtaatcgcggaacagcatgccgcggtgaatacgttcccgggccttgtacacaccgcccgtcacaccatgggagttgggtttacccgaagacggtgcgtcaacctgttcgcaggaggcagccggccacggtaagctcagcgactggggtgaagtcgtaacaaggtagccgtaggggaacctgcggctggatcacctcctttcta

SEQ ID NO: 7754 - DNA, 1466 bp, Rhodobacteraceae bacterium WDS1C4
  ref <308>: DATABASE ACCESSION NUMBER: NCBI ACCESSION: NZ_MSIT01000002.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgaacgaagccttcgggcttagtggcggacgggttagtaacgcgtgggaatgtacccttcactacggaatagtccctggaaacggggtttaataccgtatacgccctttgggggaaagaatatcggtgatggatcagcccgcgttagattaggtagttggtggggtaacggcctaccaagcctacgatctatagctggtttgagaggatgatcagcaacactgggactgagacacggcccagactcctacgggaggcagcagtggggaatcttagacaatgggggaaaccctgatctagccatgccgcgtgagtgacgaaggtcttaggatcgtaaagctctttcaactgtgaagataatgacggtagcagtagaagaaaccccggctaactccgtgccagcagccgcggtaatacggagggggttagcgttgttcggaattactgggcgtaaagcgcacgtaggcggactattaagtcaggggtgaaatcccggggctcaaccccggaactgcctttgatactggtagtctagagttcgagagaggtgagtggaattccgagtgtagaggtgaaattcgtagatattcggaagaacaccagtggcgaaggcggctcactggctcgatactgacgctgaggtgcgaaagtgtgggtagcaaacaggattagataccctggtagtccacaccgtaaacgttgaatgccagtcgtcagggggcttgccccttggtgacacacctaacggagtaagcattccgcctggggagtacggccgcaaggttaaaactcaaaggaattgacgggggcccgcacaagcggtggagcatgtggtttaattcgaagcaacgcgcagaaccttaccaacccttgacatcctgtgctaacccgagagatcgggcgttcccttcggggacgcagtgacaggtgctgcatggctgtcgtcagctcgtgtcgtgagatgttcggttaagtccggcaacgagcgcaacccacgcccttagttaccagcggttcggccgggaactctaggggaactgcccgtgataagcgggaggaaggtgtggatgacgtcaagtcctcatggcccttacgggttgggctacacacgtgctacaatggcatctacagaggggtaacccctaaaagatgtctcagttcggattgtcgtctgcaactcgacggcatgaagtcggaatcgctagtaatcgcggaacagcatgccgcggtgaatacgttcccgggccttgtacacaccgcccgtcacaccatgggagttggttttacccgacgacgctgcgctaaccttcgggaggcaggcggccacggtaagatcagcgactggggtgaagtcgtaacaaggtagccgtaggggaacctgcggctggatcacctcctttctaa

SEQ ID NO: 7755 - DNA, 1468 bp, Rhodobacteraceae bacterium WDS4C29
  ref <308>: DATABASE ACCESSION NUMBER: NCBI ACCESSION: NZ_QETF01000017.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgaacgaagccttcgggcttagtggcggacgggttagtaacgcgtgggaatgtacccttcactacggaatagtcccgggaaactgggtttaataccgtatacgcccttcgggggaaagaatttcggtgagggatcagcccgcgttagattaggtagttggtggggtaatggcctaccaagcctacgatctatagctggtttgagaggatgatcagcaacactgggactgagacacggcccagactcctacgggaggcagcagtggggaatcttggacaatgggggaaaccctgatccagccatgccgcgtgagtgacgaaggccctagggtcgtaaagctctttcaactgtgaagataatgacggtagcagtagaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcagagggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcccttcgggggcgcagtgacaggtgctgcatggctgtcgtcagctcgtgtcgtgagatgttcggttaagtccggcaacgagcgcaacccacgcccttagttaccagcggttcggccgggaactctaggggaactgcccgtgataagcgggaggaaggtgtggatgacgtcaagtcctcatggcccttacgggttgggctacacacgtgctacaatggcatctacagtgggttaatccccaaaagatgtctcagttcggattgttctctgcaactcgagagcatgaagtcggaatcgctagtaatcgcgtaacagcatgacgcggtgaatacgttcccgggccttgtacacaccgcccgtcacaccatgggagttggttctacccgacgacgctgcgctaacctttctagggggcaggcggccacggtaggatcagcgactggggtgaagtcgtaacaaggtagccgtaggggaacctgcggctggatcacctcctttctaa

SEQ ID NO: 7756 - DNA, 1471 bp, Rhodobacteraceae bacterium WFHF2C18
  ref <308>: DATABASE ACCESSION NUMBER: NCBI ACCESSION: NZ_NHTQ01000003.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaagccttcgggcttagcggcggacgggtgagtaacgcgtgggaacgtacccttcagtgcggaatagcctctggaaacggagattaataccgcatacgccctacgggggaaagaatttcgctgaaggatcggcccgcgttagattaggtagttggtggggtaacagcctaccaagcctacgatctatagctggttttagaggatgatcagccacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcagaaagttgggggtgaaatcccagggctcaaccctggaactgcctccaaaactactggtctagagttcgagagaggtgagtggaattccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgttgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctggtcgcggtttccggagacggattccttcagttcggctggaccagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtgtctacagaaggttaatcctcaaaagacatctcagttcggattgtcctctgcaactcgagggcatgaagtcggaatcgctagtaatcgcggaacagcatgccgcggtgaatacgttcccgggccttgtacacaccgcccgtcacaccatgggagttgggcctacccgacggccgtgcgctaacccgcaagggaggcagcggaccacggtaagctcagcgactggggtgaagtcgtaacaaggtagccgtaggggaacctgcggctggatcacctcctttctaa

SEQ ID NO: 7757 - DNA, 1471 bp, Rhodobacteraceae bacterium Water-Bin34
  ref <308>: DATABASE ACCESSION NUMBER: NCBI ACCESSION: NZ_FZLS01000019.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgctaccttcgggtggagcggcggacgggttagtaacgcgtgggaatatacccagttctaaggaatagccactggaaacggtgagtaataccttatacgcccttcgggggaaagatttatcggaattggattagcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgaagaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggattggaaagttgggggtgaaatcccggggctcaaccccggaactgcctccaaaactatcagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgacgcaacgcgcagaaccttaccaacccttgacatacttgtcgcggattccagagatggattccttcagttcggctggacaatgtacaggtgctgcatggctgtcgtcagctcgtgtcgtgagatgttcggttaagtccggcaacgagcgcaacccacgtccttagttaccagcatttagttgggtaccctaaggagactgccggtgataagccggaggaaggtgtggacgacgtcaagtcatcatggcccttacgggttgggctacacacgtgctacaatggcatctacagtgagttaatctccaaaagatgtctcagttcggattggggtctgcaactcgaccccatgaagttggaatcgctagtaatcgcggaacagcatgccgcggtgaatacgttcccgggccttgtacacaccgcccgtcacaccatgggaattgggtctacccgaaggtggtgcgccaactatttatagaggcagccaaccacggtaggttcagtgactggggtgaagtcgtaacaaggtagccgtaggggaacctgcggctggatcacctcctttctaa

SEQ ID NO: 7758 - DNA, 1471 bp, Rhodobacterales bacterium HTCC2255
  ref <308>: DATABASE ACCESSION NUMBER: NCBI ACCESSION: NZ_DS022282.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgctaccttcgggtggagcggcggacgggttagtaacgcgtgggaatatacccagttctaaggaatagccactggaaacggtgagtaataccttatacgcccttcgggggaaagatttatcggaattggattagcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcaactgtgaagataatgacggtagcagtagaagaaaccccggctaactccgtgccagcagccgcggtaatacggagggggttagcgttgttcggaattactgggcgtaaagcgtacgtaggcggattaataagttagaggtgaaatcccagggctcaaccctggaactgcctttaaaactgttagtcttgagatcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgacgcaacgcgcagaaccttaccaacccttgacatacttgtcgcggattccagagatggattccttcagttcggctggacaatgtacaggtgctgcatggctgtcgtcagctcgtgtcgtgagatgttcggttaagtccggcaacgagcgcaacccacgtccttagttaccagcatttagttgggtaccctaaggagactgccggtgataagccggaggaaggtgtggacgacgtcaagtcatcatggcccttacgggttgggctacacacgtgctacaatggcatctacagtgagttaatctccaaaagatgtctcagttcggattggggtctgcaactcgaccccatgaagttggaatcgctagtaatcgcggaacagcatgccgcggtgaatacgttcccgggccttgtacacaccgcccgtcacaccatgggaattgggtctacccgaaggtggtgcgccaactatttataggggcagccaaccacggtaggttcagtgactggggtgaagtcgtaacaaggtagccgtaggggaacctgcggctggatcacctcctttctaa

SEQ ID NO: 7759 - DNA, 1506 bp, Rhodobiaceae bacterium
  ref <308>: DATABASE ACCESSION NUMBER: NCBI ACCESSION: NZ_CP030277.1
  ref <309>: DATABASE ENTRY DATE: 2019-04-01
  ref <313>: RELEVANT RESIDUES IN SEQ ID NO: (1)..(1506)
caacttgagagtttgatcctggctcagaacgaacgctggcggcaggcttaacacatgcaagtcgaacgagaagctaccttcgggtagtggaaagtggcagacgggtgagtaacgcgtgggaatatacctagaggtacggaacaacgccgggaaactggtgctaataccgtatgtgcccttcgggggaaagatttatcgcctttagattagcccgcgttagattagcttgttggtgaggtaaaagctcaccaaggcgacgatctatagctggtctgagaggatgatcagccacactgggactgagacacggcccagactcctacgggaggcagcagtggggaatcttgcacaatgggcgaaagcctgatgcagccatgccgcgtgtgtgatgaaggccttagggttgtaaaacactttcagaggggaagataatgacggtaccctcagaagaagctccggctaactccgtgccagcagccgcggtaatacggagggagctagcgttgttcggaattactgggcgtaaagcgcgcgtaggcggattgattagtcagaggtgaaatcccagggctcaaccctggaactgcctttgatactgtcagtctagagaccgagagaggtgagtggaatttccagtgtagaggtgaaattcgtagatattggaaagaacaccagtggcgaaggcggctcactggctcggtactgacgctgaggtgcgaaagcgtggggagcaaacaggattagataccctggtagtccacgccgtaaacgatgagagctagttgtcaggcagtatactgtttggtgacgcagctaacgcattaagctctccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttaggctggatcagtgacaggtgttgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcctcatggcccttatgggttgggctacacacgtgctacaatggcggcgacagagggcagcgaccccgcgagggtgagctaatctccaaaagccgtctcagttcggattgttctctgcaactcgagagcatgaaggtggaatcgctagtaatcgcagaacagctatgctgcggtgaatacgttcccgggccttgtacacaccgcccgtcacatcatgggagttggctttacccgaaggtggtgcgctaacctagcaataggaggcagccaaccacggtaaggtcagcgactgggatgaagtcgtaacaaggtagccctaggggaacctggggctggatcacctcctttctaag

SEQ ID NO: 7760 - DNA, 1490 bp, Rhodobium orientis
  ref <308>: DATABASE ACCESSION NUMBER: NCBI ACCESSION: NZ_NPEV01000027.1
  ref <309>: DATABASE ENTRY DATE: 2019-04-01
  ref <313>: RELEVANT RESIDUES IN SEQ ID NO: (1)..(1490)
aacctgagagtttgatcctggctcaggacgaacgctggcggcaggcctaacacatgcaagtcgaacgcaccttcgggtgagtggcagacgggtgagtaacgcgtgggaatctacccattggtgcggaataactcggggaaactcgggctaataccgcataagccctccgggggaaagatttatcgccaatggatgagcccgcgttggattagctagttggtggggtaatggcccaccaaggcgacgatccatagctggtctgagaggatgatcagccacactgggactgagacacggcccagactcctacgggaggcagcagtgaggaatattggacaatgggcgcaagcctgatccagccatgccgcgtgagtgatgaaggccctagggttgtaaagctctttcagtagggaagataatgacggtacctacagaagaagccccggctaacttcgtgccagcagccgcggtaatacgaagggggctagcgttgttcggaattactgggcgtaaagcgcgcgtaggcggattgttaagtcaggggtgaaatcccgaggctcaacctcggaactgcctttgatactggcaatctagagtccggaagaggtgagtggaattcctagtgtagaggtgaaattcgtagatattaggaagaacaccagtggcgaaggcggctcactggtccggaactgacgctgaggtgcgaaagcgtggggagcaaacaggattagataccctggtagtccacgccgtaaacgatggatgctagccgtcggccagcttgctggtcggtggcgcagctaacgcattaagcatcccgcctggggagtacgatcgcaagattaaaactcaaaggaattgacgggggcccgcacaagcggtggagcatgtggtttaattcgaagcaacgcgcagaaccttaccaacccttgacatcccgatcgcggttaccggagacggtttccttcagttcggctggatcggtgacaggtgctgcatggctgtcgtcagctcgtgtcgtgagatgttgggttaagtcccgcaacgagcgcaaccctcgcccttagttgccagcatttagttgggcactctaaggggactgccggtgataagccggaggaaggtggggatgacgtcaagtcctcatggcccttacgggttgggctacacacgtgctacaatggcggtgacagtgggcagcgacttcgcgaggaggagctaatccccaaaagccgtctcagttcggattgttctctgcaactcgagagcatgaagtcggaatcgctagtaatcgcagatcagcttgctgcggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaag

SEQ ID NO: 7761 - DNA, 1490 bp, Rhodoblastus sphagnicola
  ref <308>: DATABASE ACCESSION NUMBER: NCBI ACCESSION: NZ_NHSJ01000060.1
  ref <309>: DATABASE ENTRY DATE: 2019-04-01
  ref <313>: RELEVANT RESIDUES IN SEQ ID NO: (1)..(1490)
caacttgagagtttgatcctggctcagaacgaacgctggcggcaggcctaacacatgcaagtcgaacggatgtagcaatacatcagtggcagacgggtgaggaacacgtgggaacataccctttggttcggaataactcagggaaacttgagctaataccggataagtcggcaacgagaaagattcatcgccgaaggaatggcccgcgtccgattagctagttggtgaggtaacggctcaccaaggcgacgatcggtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcacccacgacgataatgacggtagtgggagaagaagccccggctaacttcgtgccagcagccgcggtaatacgaagggggctagcgttgttcggatttactgggcgtaaagcgcacgtaggcggatctttaagtcaggggtgaaatgccggagctcaacttcggaactgcctttgatactggagatcttgagttcgagagaggtgagtggaactgcgagtgtagaggtgaaattcgtagatattcgcaagaacaccagtggcgaaggcggctcactggctcgatactgacgctgaggtgcgaaagcgtggggagcaaacaggattagataccctggtagtccacgccgtaaacgatggatgctagccgttaggcagcttgctgcttagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgtcctggacggtttccagagatggattcctctcttcggagccaggaacacaggtgctgcatggctgtcgtcagctcgtgtcgtgagatgttgggttaagtcccgcaacgagcgcaacccacgtccttagttgccatcatttagttgggcactctagggagactgccggtgataagccgagaggaaggtgtggatgacgtcaagtcctcatggcccttacaggctgggctacacacgtgctacaatggcggtgacaatgggatgcgaaggggcgacccttagcaaatctcaaaaatccgtctcagttcggattgttctctgcaactcgagagcatgaaggtggaatcgctagtaatcgcagatcagaacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttcta

SEQ ID NO: 7762 - DNA, 1524 bp, Rhodococcus agglutinans
  ref <308>: DATABASE ACCESSION NUMBER: NCBI ACCESSION: NZ_RKLP01000019.1
  ref <309>: DATABASE ENTRY DATE: 2019-04-01
  ref <313>: RELEVANT RESIDUES IN SEQ ID NO: (1)..(1524)
ttcaacggagagtttgatcctggctcaggacgaacgctggcggcgtgcttaacacatgcaagtcgagcggtaaggccccttcgggggtacacgagcggcgaacgggtgagtaacacgtgggtgatctgccctgcactctgggataagcctgggaaactgggtctaataccggatatgagctcctgtcgcatggcgggggttggaaaggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgaaagtgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaaacccgcagctcaactgcgggcttgcaggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaa

SEQ ID NO: 7763 - DNA, 1523 bp, Rhodococcus globerulus
  ref <308>: DATABASE ACCESSION NUMBER: NCBI ACCESSION: NZ_QEOC01000001.1
  ref <309>: DATABASE ENTRY DATE: 2019-04-01
  ref <313>: RELEVANT RESIDUES IN SEQ ID NO: (1)..(1523)
ttcaacggagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggacgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcacgtcgtttgtgaaaactcacagctcaactgtgagcctgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaaggtgggatcggcgattgggacgaagtcgtaacaaggtagccgtaccggaaggtgcggctggatcacctcctttctaa

SEQ ID NO: 7764 - DNA, 1524 bp, Rhodococcus opacus
  ref <308>: DATABASE ACCESSION NUMBER: NCBI ACCESSION: NZ_NWMZ01000001.1
  ref <309>: DATABASE ENTRY DATE: 2019-04-01
  ref <313>: RELEVANT RESIDUES IN SEQ ID NO: (1)..(1524)
ttcaacggagagtttgatcctggctcaggacgaacgctggcggcgtgcttaacacatgcaagtcgagcggtaaggcccttcggggtacacgagcggcgaacgggtgagtaacacgtgggtgatctgccctgcacttcgggataagcctgggaaactgggtctaataccggatatgaccttcggctgcatggctgagggtggaaaggtttactggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgaaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaactcgaggctcaacctcgagcttgcaggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7765 - DNA, 1528 bp, Rhodococcus ruber
  ref <308>: DATABASE ACCESSION NUMBER: NCBI ACCESSION: NZ_JXXO01000289.1
  ref <309>: DATABASE ENTRY DATE: 2019-04-01
  ref <313>: RELEVANT RESIDUES IN SEQ ID NO: (1)..(1528)
ttcaacggagagtttgatcctggctcaggacgaacgctggcggcgtgcttaacacatgcaagtcgaacgatgaagcccagcttgctgggtggattagtggcgaacgggtgagtaacacgtgggtgatctgccctgcacttcgggataagcctgggaaactgggtctaataccggataggacctcgggatgcatgttccggggtggaaaggttttccggtgcaggatgggcccgcggcctatcagcttgttggtggggtaacggcccaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagtaccgacgaagcgcaagtgacggtaggtacagaagaagcaccggccaactacgtgccagcagccgcggtaatacgtagggtgcgagcgttgtccggaattactgggcgtaaagagctcgtaggcggtttgtcgcgtcgtctgtgaaaacccgcagctcaactgcgggcttgcaggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaccgccccagagatggggtttcccttgtggtcggtgtacaggtggtgcatggctgtcgtcagctcgtgtcgtgagatgttgggttaagtcccgcaacgagcgcaacccttgtcctgtgttgccagcacgtaatggtggggactcgcaggagactgccggggtcaactcggaggaaggtggggacgacgtcaagtcatcatgccccttatgtccagggcttcacacatgctacaatggccggtacagagggctgcgataccgcgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccctcgtgggagggagccgtcgaaggtgggatcggcgattgggacgaagtcgtaacaaggtagccgtaccggaaggtgcggctggatcacctcctttctaa

SEQ ID NO: 7766 - DNA, 1523 bp, Rhodococcus sp. 1168
  ref <308>: DATABASE ACCESSION NUMBER: NCBI ACCESSION: NZ_MKKY01000024.1
  ref <309>: DATABASE ENTRY DATE: 2019-04-01
  ref <313>: RELEVANT RESIDUES IN SEQ ID NO: (1)..(1523)
ttttacggagagtttgatcctggctcaggacgaacgctggcggcgtgcttaacacatgcaagtcgagcggtaaggcccttcggggtacacgagcggcgaacgggtgagtaacacgtgggtgatctgccctgcactctgggataagcctgggaaactgggtctaataccggatatgacctgctctcgcatgggggtgggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggacgaagcgcaagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacggaatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagccgtagagatacggccccccttgtggtcggtgtacaggtggtgcatggctgtcgtcagctcgtgtcgtgagatgttgggttaagtcccgcaacgagcgcaacccctatcttatgttgccagcgcgttatggcggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7767 - DNA, 1516 bp, Rhodococcus sp. BS-15
  ref <308>: DATABASE ACCESSION NUMBER: NCBI ACCESSION: NZ_BAOX01000527.1
  ref <309>: DATABASE ENTRY DATE: 2019-04-01
  ref <313>: RELEVANT RESIDUES IN SEQ ID NO: (1)..(1516)
ggagagtttgatcctggctcaggacgaacgctggcggcgtgcttaacacatgcaagtcgagcggtaaggcctttcggggtacacgagcggcgaacgggtgagtaacacgtgggtgatctgccctgcactctgggataagcttgggaaactgggtctaataccggatatgactacagcatgcatgtgttgtggtggaaagatttatcggtgcaggatgggcccgcggcctatcagcttgttggtggggtaatggcctaccaaggcgacgacgggtagcgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcgcgttatggcggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccctcgtgggagggagccgtcgaaggtgggatcggcgattgggacgaagtcgtaacaaggtagccgtaccggaaggtgcggctggatcacctcctttctaa

SEQ ID NO: 7768 - DNA, 1523 bp, Rhodococcus sp. Eu-32
  ref <308>: DATABASE ACCESSION NUMBER: NCBI ACCESSION: NZ_QGNK01000043.1
  ref <309>: DATABASE ENTRY DATE: 2019-04-01
  ref <313>: RELEVANT RESIDUES IN SEQ ID NO: (1)..(1523)
ttttacggagagtttgatcctggctcaggacgaacgctggcggcgtgcttaacacatgcaagtcgagcggtaaggcctttcggggtacacgagcggcgaacgggtgagtaacacgtgggtgatctgccctgcactctgggataagcctgggaaactgggtctaataccggatatgaccattccatgcatgtggggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccagacagctgtagagatacggtttcccttgtggttggtgtacaggtggtgcatggctgtcgtcagctcgtgtcgtgagatgttgggttaagtcccgcaacgagcgcaacccttgtcttatgttgccagcacgtgatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7769 - DNA, 1523 bp, Rhodococcus sp. H-CA8f
  ref <308>: DATABASE ACCESSION NUMBER: NCBI ACCESSION: NZ_CP023720.1
  ref <309>: DATABASE ENTRY DATE: 2019-04-01
  ref <313>: RELEVANT RESIDUES IN SEQ ID NO: (1)..(1523)
ttcaacggagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaaggtgggatcggcgattgggacgaagtcgtaacaaggtagccgtaccggaaggtgcggctggatcacctcctttctaa
